US 7,026,116 B1

(12) United States Patent  
Ruddy et al.

(10) Patent No.: US 7,026,116 B1  
(45) Date of Patent: Apr. 11, 2006

(54) POLYMORPHISMS IN THE REGION OF THE HUMAN HEMOCHROMATOSIS GENE

(75) Inventors: David A. Ruddy, San Francisco, CA (US); Roger K. Wolff, Mill Valley, CA (US)

(73) Assignee: Bio-Rad Laboratories, Inc., Hercules, CA (US)

( * ) Notice: Subject to any disclaimer, the term of this patent is extended or adjusted under 35 U.S.C. 154(b) by 0 days.

(21) Appl. No.: 08/852,495

(22) Filed: May 7, 1997

Related U.S. Application Data

(63) Continuation-in-part of application No. 08/724,394, filed on Oct. 1, 1996, now Pat. No. 5,872,237, and a continuation-in-part of application No. 08/652,265, filed on May 23, 1996, now Pat. No. 6,025,130, which is a continuation-in-part of application No. 08/630,912, filed on Apr. 4, 1996, now abandoned.

(51) Int. Cl.  
*C07H 21/04* (2006.01)  
*C12Q 1/68* (2006.01)

(52) U.S. Cl. .................. 435/6; 536/23.1; 536/24.3

(58) Field of Classification Search .............. 435/6; 536/23.1, 24.3  
See application file for complete search history.

(56) References Cited

U.S. PATENT DOCUMENTS

| | | | |
|---|---|---|---|
| 4,399,216 A | 8/1983 | Axel et al. | |
| 4,434,156 A | 2/1984 | Trowbridge | |
| 4,511,503 A | 4/1985 | Olson et al. | |
| 4,666,927 A | 5/1987 | Hider et al. | |
| 4,683,202 A | 7/1987 | Mullis | |
| 4,711,845 A | 12/1987 | Gelfand et al. | |
| 4,912,118 A | 3/1990 | Hider et al. | |
| 5,075,469 A | 12/1991 | Chevion | |
| 5,104,865 A | 4/1992 | Hider et al. | |
| 5,116,964 A | 5/1992 | Capon | |
| 5,185,368 A | 2/1993 | Peter et al. | |
| 5,256,676 A | 10/1993 | Hider et al. | |
| 5,328,992 A | 7/1994 | Peter et al. | |
| 5,385,918 A | 1/1995 | Connell et al. | |
| 5,399,346 A | 3/1995 | Anderson et al. | |
| 5,420,008 A | 5/1995 | Nishida et al. | |
| 5,424,057 A | 6/1995 | Peter et al. | |
| 5,474,796 A * | 12/1995 | Brennan ............... 427/2.13 | |
| 5,582,979 A * | 12/1996 | Weber ................... 435/6 | |
| 5,705,343 A | 1/1998 | Drayna et al. | |
| 5,712,098 A | 1/1998 | Tsuchihashi et al. | |
| 5,719,125 A * | 2/1998 | Suzuki et al. ............ 514/12 | |
| 5,753,438 A | 5/1998 | Drayna et al. | |
| 5,872,237 A * | 2/1999 | Feder et al. ............ 536/23.5 | |
| 6,025,130 A | 2/2000 | Thomas et al. | |
| 6,140,305 A | 10/2000 | Thomas et al. | |
| 6,228,594 B1 | 5/2001 | Thomas et al. | |
| 6,284,732 B1 | 9/2001 | Feder et al. | |
| 6,391,852 B1 | 5/2002 | Feder et al. | |

2003/0092019 A1 * 5/2003 Meyer et al. .......... 435/6

FOREIGN PATENT DOCUMENTS

| | | |
|---|---|---|
| CA | 2115221 | 8/1994 |
| CA | 2115222 | 8/1994 |
| CA | 2115224 | 8/1994 |
| DE | 208 609 | 4/1984 |
| DE | 4 327 226 | 2/1995 |
| EP | 0 315 434 | 5/1989 |
| EP | 0 346 281 | 12/1989 |
| EP | 97910741 | 6/2003 |
| GB | 2 293 269 | 3/1996 |
| WO | WO 92/06180 | 4/1992 |
| WO | WO 93/14188 | 7/1993 |
| WO | WO 93/15609 | 8/1993 |
| WO | WO 93/19768 | 10/1993 |
| WO | WO 93/20221 | 10/1993 |
| WO | WO 94/01463 | 1/1994 |
| WO | WO 94/04186 | 3/1994 |
| WO | WO 94/06922 | 3/1994 |
| WO | WO 94/06923 | 3/1994 |
| WO | WO 94/11367 | 5/1994 |
| WO | WO 94/21243 | 9/1994 |
| WO | WO 95/16663 | 6/1995 |
| WO | WO 96/06583 | 3/1996 |
| WO | WO 96/17870 | 6/1996 |
| WO | WO 96/35802 | 11/1996 |
| WO | WO 97/38137 | 10/1997 |

OTHER PUBLICATIONS

Ioannidis et al. "Replication validity of genetic association studies." Nature Genetics, vol. 29, pp. 306–309, Nov. 2001.*  
Hirschhorn et al. "A comprehensive review of genetic association studies." Genetics In Medicine. vol. 4, No. 2, pp. 45–61, Apr. 2002.*  
Ahern The Scientist, vol. 9, No. 15, p. 20, Jul. 1995.*  
Pease et al. "Light generated oligonucleotide arrays for rapid DNA sequence analysis." PNAS. vol. 91, pp. 5022–5026, Ma 1994.*  
Campbell, Ailsa M. in: Monoclonal Antibody Technology. ed. Campbell. Elsevier Science Publishers, Amsterdam, NL. pp. 1–32, 1985.*  
Cornall. RJ et al. Genomics. 10(4):874–881, Aug. 1991.*  
Vogel, F. and Motulsky, AG. In: Human Genetics. Vogel and Motulsky, eds. Springer–Verlag, Berlin. pp. 18–81, 1982.*  
Boretto, J et al. Human Genetics. 89(1):33–36, Jan. 1992.*  
Barton, J.C., et al., *"Blood Lead Concentrations in Hereditary Hemochromatosis,"* J. Lab. Clin. Med. (1994) 124(2):193–198 (0022–2143/94).  
Beutler, E., et al., *"A Strategy for Cloning the Hereditary Hemochromatosis Gene,"* Blood Cells, Molecules, and Diseases (1995) 21(21):207–216 (1079–9796/95).

(Continued)

Primary Examiner—Jeanine A. Goldberg  
(74) Attorney, Agent, or Firm—Jones Day

(57) ABSTRACT

Polymorphic sites in the region surrounding the HH gene are provided. These polymorphisms are useful as surrogate markers in diagnostic assays for hemochromatosis.

9 Claims, 147 Drawing Sheets

OTHER PUBLICATIONS

Bjorkman, P.J., et al., "Structure, Function, and Diversity of Class I Major Histocompatibility Complex Molecules," Annu. Rev. Biochem. (1990) 59:253–288 (0066–4154/90).

Calandro, L.M., et al., "Characterization of a Recombinant That Locates the Hereditary Hemochromatosis Gene Telomeric to HLA–F," Hum. Genet. (1995) 96:339–342 (Kaiser Foundation Research Institute).

Camaschella, C., et al., "Hereditary Hemochromatosis: Recent Advances in Molecular Genetics and Clinical Management," Haematologica (1997) 82:77–84 (BioMed).

Capecchi, M.R., "Altering the Genome by Homologous Recombination," Science (1989) 244:1288–1292 (Univ. of Utah Medical Center).

Cartwright, G.E., et al., "Inheritance of Hemochromatosis: Linkage to HLA," Trans. Assoc. Am. Phys. (1978) 91:273–281 (National Institutes of Health).

Chen, X., et al., "Template–Directed Dye–Terminator Incorporation (TDI)Assay: A Homogeneous DNA Diagnostic Method Based on Fluorescence Resonance Energy Transfer," Nucl. Acids Res. (1997) 25(2):347–353 (U.S. Dept. of Energy).

Crawford, D.H.G., et al., "Evidence That the Ancestral Haplotype in Australian Hemochromatosis Patients May be Associated With a Common Mutation in the Gene," Am. J. Hum. Genet. (1995) 57:362–367 (0002–9297/95).

Crystal, R.G., "Gene Therapy Strategies of Pulmonary Disease," Am. J. Med. (1992) 92(6A):6A–44S–6A–52S (National Institutes of Health).

Darnell, J., "Molecular Cell Biology," Scientific American Books (1986) pp. 227–229 (Rockefeller Univ.).

Dugast, I.J., et al., "Identification of Two Human Ferritin H Genes on the Short Arm of Chromosome 6," Genomics (1990) 6:204–211 (0888–7543/90).

Edwards, C.Q., et al., "The Locus for Hereditary Hemochromatosis Maps Between HLA–A and HLA–B," Cytogenet. Cell Genet. (1985) 40:620 (Univ. of Utah Medical Center).

El Kahloun, A., et al., "Localization of Seven New Genes Around the HLA–A Locus," Hum. Molec. Genet. (1992) 2(1):55–60 (Institut National de la Sante et de la Recherche Medicale).

Friedmann, T., "Progress Toward Human Gene Therapy," Science (1989) 244:1275–1281 (San Diego Univ. of Calif.).

Fullan, A., et al., "A Polymorphic Dinucleotide Repeat at the Human HLA–F Locus," Hum. Mol. Genet. (1994) 3(12):2266 (Mercator Genetics).

Gasparini, P., et al., "Linkage Analysis of 6p21 Polymorphic Markers and the Hereditary Hemochromatosis: Localization of the Gene Centromeric to HLA–F," Hum. Molec. Genet. (1993) 2(5):571–576 (National Research Council).

Gnirke, A., et al., "Physical Calibration of Yeast Artificial Chromosome Contig Maps by RecA–Assisted Restriction Endonuclease (RARE) Cleavage," Genomics (1994) 24:199–210 (0888–7543/94).

Goei, V.L., et al., "Isolation of Novel Non–HLA Gene Fragments From the Hemochromatosis Region (6p21.3)by cDNA Hybridization Selection," Am. J. Hum. Genet. (1994) 54:244–251 (0002–929/94).

Gorski, J., "HLA–DR β–Chain Polymorphism: Second Domain Polymorphism Reflects Evolutionary Relatedness of Alleles and May Explain Public Serologic Epitopes," J. Immunol. (1989) 143(1):329–333 (0022–1767/89).

Gruen, J.R., et al., "Physical and Genetic Mapping of the Telomeric Major Histocompatibility Complex Region in Man and Relevance to the Primary Hemochromatosis Gene ( HFE)," Genomics (1992) 14:232–240 (0378–7543/92).

Halliday, J.W., "Hemochromatosis and Iron Needs," Nutr. Rev. (1998) 56(2)S30–S37 (Queensland Institute of Medical Research).

Harlow, E., et a., "Antibodies: A Laboratory Manual," Cold Spring Harbor Laboratory (1988) Chapter 5 pp. 75–81 (ISBN 0–87969–314–2).

Hashimoto, K., et al., "Identification of a Mouse Homolog for the Human Hereditary Haemochromatosis Candidate Gene," Biochem. Biophys. Res. Comm. (1997) 230:35–39 (0006–291X/97).

Jakobovits, A., et al., "Production of Antigen–Specific Human Antibodies from Mice Engineered with Human Heavy and Light Chain YACs", Ann. N.Y. Acad. Sci. (1995) 764:525–535 (Cell Genesys, Inc.).

Jazwinska, E.C., et al., "Where Does the Gene for Hemochromatosis Lie in Relation to HLA–A?," Hepatology (1994) 19:1050–1051 (Queensland Institute of Medical Research).

Jazwinska, E.C., et al., "Hemochromatosis and "HLA–H": Definite!", Hepatology (1997) 25(2):495–496 (Queensland Institute of Medical Research).

Jouet, M.M.H., et al., "Isolation of YAC Clones Containing Class 1 HLA Genes Which Map in the Vicinity of the Hereditary Haemochromatosis Gene," J. Med. Genet. (1991) 28(8):572 (St. Mary's Hospital, Manchester).

Koller, B.H., et al., "Normal Development of Mice Deficient in $\beta_2$ M, MHC Class I Proteins, and $CD8^+T$ Cells," Science (1990) 248:1227–1230 (National Institutes of Health).

Kramer, M.F., et al., "The Polymerase Chain Reaction," Current Protocols in Molecular Biology (1993) Chapter 15 pp. 15.0.1–15.1.14 (ISBN 0–471–30661–4).

Lemarchand, P., et al., "Adenovirus–Mediated Transfer of a Recombinant Human $\alpha_1$–Antitrypsin cDNA to Human Endothelial Cells," Proc. Natl. Acad. Sci. USA (1992) 89:6482–6486 (National Institutes of Health).

Lin, A.Y., et al., "Expression of T Cell Antigen Receptor Heterodimers in a Lipid–Linked Form," Science (1990) 249:677–679 (Stanford Univ. School of Medicine).

Lipinski, M., et al., "Idiopathic Hemochromatosis: Linkage with HLA," Tissue Antigens (1978) 11:471–474 (Hospital Saint–Louis, Paris).

Miyazaki, J.I., et al., "Intracellular Transport Blockade Caused by Disruption of the Disulfide Bridge in the Third External Domain of Major Histocompatibility Complex Class I Antigen," Proc. Natl. Acad. Sci. USA (1986) 83:757–761 (National Institutes of Health).

Morgan, J.G., et al., "The Selective Isolation of Novel cDNAs Encoded by the Regions Surrounding the Human Interleukin 4 and 5 Genes," Nucl. Acids Res. (1992) 20(19):5173–5179 (National Center for Human Genome Research).

Mulford, C.A., et al., "Endocytosis of the Transferrin Receptor is Altered During Differentiation of Murine Erythroleukemic Cells," J. Biol. Chem. (1988) 263(11):5455–5461 (National Institutes of Health).

Murray, J.C., et al., "A Comprehensive Human Linkage Map with Centimorgan Density," Science (1994) 265:2049–2054 (Univ. of Iowa).

Nickerson, D.A., et al., "Automated DNA Dignostics Using an ELISA–Based Oligonucleotide Ligation Assay," Proc. Natl. Acad. Sci. USA (1990) 87:8923–8927 (Whittier Foundation).

Nickerson, D.A., et al., "*Genotyping by Ligation Assays,*" Current Protocols in Human Genetics (1994) Chapter 2.6 pp. 2.6.1–2.6.4 (ISBN 0–471–03420–7).

Olynyk, J.K., et al., "*Hepatic Iron Concentration as a Predictor of Response to Interferon Alfa Therapy in Chronic Hepatitis C,*" Gastroenterology (1995) 108:1104–1109 (0016–5085/95).

Orphanos, V., et al., "*Thirteen Dinucleotide Repeat Polymorphisms on Chromosome 6,*" Hum. Mol. Genet. (1993) 2(12):2196 (Cancer Genetics).

Patterson, M., et al., "*Molecular Characterization of Cell Cycle Gene CDC7 From Saccharomyces Cerevisiae,*" Mol. Cell Biol. (1986) 6(5):1590–1598 (0270–7306/86).

Raha–Chowdhury, R., et al., "*Allelic Associations and Homozygosity at Loci from HLA–B to D6S299 in Genetic Haemochromatosis,*" J. Med. Genet. (1995) 32:446–452 (Univ. of Wales College of Medicine).

Roth, M.P., et al., "*The Human Myelin Oligodendrocyte Glycoprotein (MOG) Gene: Complete Nucleotide Sequence and Structural Characterization,*" (1995) Genomics 28:241–250 (0888–7543/95).

Rothenberg, B.E., et al., "*The Molecular Mechanisms of Iron Overload: An Animal Model for Hemochromatosis,*" FASEB J. (1994) 8. Abstract No. 5217, p. A900 (Univ. of California).

Salter, R.D., "*Intracellular Transport of Class 1 HLA Molecules is Affected by Polymorphic Residues in the Binding Groove,*" Immunogenetics (1994) 39:266–271 (American Cancer Society).

Schild, H., et al., "*The Nature of Major Histocompatibility Complex Recognition by γδ T Cells*" Cell (1994) 76:29–37 (German Cancer Research Center).

Sevier, E.D., "*Monoclonal Antibodies in Clinical Immunology,*" Clin. Chem. (1981) 27(11):1797–1806 (Hybritech, Inc.).

Sood, A. K., et al., "*Isolation and Partial Nucleotide Sequence of a cDNA Clone for Human Histocompatibility Antigen HLA–B by Use of an Oligodeoxynucleotide Primer,*" Proc. Natl. Acad. Sci. USA (1981) 78(1):616–620 (National Institutes of Health).

Summers, K.M., et al., "*Fine Mapping of a Human Chromosome 6 Ferritin Heavy Chain Pseudogene: Relevance to Haemochromatosis,*" Hum. Genet. (1991) 88:175–178 (Queensland Institute of Medical Research).

Totaro, A., et al., "*New Polymorphisms and Markers in the HLA Class I Region: Relevance to Hereditary Hemochromatosis (HFE),*" Hum. Genet. (1995) 95:429–434 (Italian Ministry of Health).

Totaro, A., et al., "*Hereditary Hemochromatosis: Generation of a Transcription Map Within a Refined and Extended Map of the HLA Class 1 Region,*" Genomics (1996) 31:319–326 (0888–7543/96).

Weber, J.L., et al., "*Dinucleotide Repeat Polymorphism at the D6S105 Locus,*" Nucl Acids Res. (1991) 19(4):968 (National Institutes of Health).

Wettstein, D.A., et al., "*Expression of a Class II Major Histocompatibility Complex ( MHC) Heterodimer in a Lipid–Linked Form With Enhanced Peptide/Soluble MHC Complex Formation at Low pH,*" J. Exp. Med. (1991) 174:219–228 (0022–1007/91).

Zijlstra, M., et al., "*β2–Microglobulin Deficient Mice Lack CD48⁺Cytolytic T Cells,*" Nature (1990) 344:742–746 (Cancer Research Institute).

Zinkernagel, R.M., et al., "*MHC–Restricted Cytotoxic T Cells: Studies on the Biological Role of Polymorphic Major Transplantation Antigens Determining T–Cell Restriction–Specificity, Function, and Responsiveness,*" Adv. In Immunol. (1979) 27:51–177 (ISBN 0–12–022427–5).

Beutler, E. et al., "*Mutation Analysis in Hereditary Hemochromatosis*" Blood Cells, Molecules, and Diseases (1996), 22(16): 187–194.

Gasparini, et al, "Where does the gene for Hemochromatosis lie in relation to HLA–A", *Hepatology* (1994), 19: 1050–1056.

Altman, J.D. et al., "Phenotypic Analysis of Antigen–Specific T Lymphocytes," *Science* 274:94–96 (1996).

Anderson, G.J. et al., "Transferrin Receptor Distribution and Regulation in the Rat Small Intestine," *Gastroenterology* 98:576–585 (1990).

Arteaga, C.L. et al., "Tissue–targeted Antisense c–fos Retroviral Vector Inhibits Established Breast Cancer Xenografts in Nude Mice," *Canc. Res.* 56:10981103 (1996).

Banerjee, D. et al., "Transferrin Receptors in the Human Gastrointestinal Tract," *Gastroenterology* 91:861–869 (1986).

Brent, R. et al., "A bacterial repressor protein or a yeast transcriptional terminator can block upstream activation of a yeast gene," *Nature* 312:612–615 (1984).

Brent, R. et al., "A Eukaryotic Transcriptional Activator Bearing the DNA Specificity of a Prokaryotic Repressor," *Cell* 43:729–736 (1985).

Carbognani, P. et al., "Transferrin Receptor Expression in Nonsmall Cell Lung Cancer," *Cancer* 78(1):178–179 (1996).

Chien, C–T. et al., "The two–hybrid system: A method to identify and clone genes for proteins that interact with a protein of interest," *Proc. Natl. Acad. Sci. U.S.A.* 88:9578–9582 (1991).

Cook, J.D. et al., "Serum Transferrin Receptor," *Annu. Rev. Med.* 44:63–74 (1993).

Cox, G.A. et al., "Overexpression of dystrophin in transgenic *mdx* mice eliminates dystrophic symptoms without toxicity," *Nature* 364:725–729 (1993).

Curiel, D.T. et al., "Adenovirus enhancement of transferrin–polylysine–mediated gene delivery," FXoc. *Natl. Acad. Sci. U.S.A.* 88:8850–8854 (1991).

Dadone, M.M. et al., "Hereditary Hemochromatosis. Analysis of Laboratory Expression of the Disease by Genotype in 18 Pedigrees," *Am. J. Clin. Pathol.* 78(2):196–207 (1982).

Dalesandro, J. et al., "Cardiac and Pulmonary Replacement," *J. Thoracic and Cardio. Surgery* 111(2):416–422 (1996).

Delahunty, C. et al., "Testing the Feasibility of DNA Typing for Human Identification by PCR and an Oligonucleotide Ligation Assay," *Am. J. Hum. Genet.* 58:1239–1246 (1996).

Edwards, C.Q. et al., "Prevalence of Hemochromatosis Among 11,065 Presumably Healthy Blood Donors," *N. Engl. J. Med.* 318(21):1355–1362 (1988).

Fahnestock, M.L. et al., "Thermal Stability Comparison of Purified Empty and Peptide–Filled Forms of a Class I MHC Molecule," *Science* 258:1658–1662 (1992).

Fahnestock, M.L. et al., "The MHC Class I Homolog Encoded by Human Cytomegalovirus Binds Endogenous Peptides," *Immunity* 3:583–590 (1995).

Feder, J.N. et al., "The Hemochromatosis Founder Mutation in HLA–H Disrupts $\beta_2$–Microglobulin Interaction and Cell Surface Expression," *J. Biol. Chem.* 272(22):14025–14028 (1997).

Friedman, J.M. et al., "Cellular Promoters Incorporated into the Adenovirus Genome: Cell Specificity of Albumin and Immunoglobulin Expression," *Mol. Cell. Biol.* 6(11):3791–3797 (1986).

Gastinel, L.N. et al., "Expression and crystallization of a soluble and functional form of an Fc receptor related to class I histocompatiblity molecules," *Proc. Natl. Acad. Sci. U.S.A.* 89:638–642 (1992).

Hatzoglou, M. et al., "Hepatic Gene Transfer in Animals Using Retroviruses Containing the Promoter from the Gene for Phosphoenolpyruvate Carboxykinase," *J. Biol. Chem.* 265(28):17285–17293 (1990).

Huber, B.E. et al., "Retroviral–mediated gene therapy for the treatment of hepatocellular carcinoma: An innovative approach for cancer therapy," *Proc. Natl. Acad. Sci. U.S.A.* 88:8039–8043 (1991).

Jahroudi, N. et al., "Endothelial–Cell–Specific Regulation of von Willebrand Factor Gene Expression," *Mol. Cell. Biol.* 14(2):999–1008 (1994).

Karin, M. et al., "Receptor–mediated Endocytosis of Transferrin in Developmentally Totipotent Mouse Teratocarcinoma Stem Cells," *J. Biol. Chem.* 256(7):3245–3252 (1981).

Keer, H.N. et al., "Elevated Transferrin Receptor Content in Human Prostate Cancer Cell Lines Assessed In Vitro and In Vivo," J. Urol., 143:381–385 (1990).

Klausner, R.D. et al., "Receptor–mediated Endocytosis of Transferrin in K562 Cells," *J. Biol. Chem.* 258:4715–4724 (1983).

Koc, O.N. et al., "Transfer of Drug Resistance Genes into Hemotopoietic Progenitors to Improve Chemotherapy Tolerance," *Sem. Oncol.* 23(1):46–65 (1996).

Letourneur, F. et al., "A Novel Di–Leucine Motif and a Tyrosine–Based Motif Independently Mediated Lysosomal Targeting and Endocytosis of CD 3 Chains," *Cell* 69:1143–1157 (1992).

Makarov, S.S., "Suppression of experimental arthritis by gene transfer of interleukin 1 receptor antagonist cDNA," *Proc. Natl. Acad. Sci. U.S.A.* 93:402406 (1996).

Marks, M.S. et al., "A Lysosomal Targeting Signal in the Cytoplasmic Tail of the (3 Chain Directs HLA–DM to MHC Class II Compartments," *J. Cell Biol.* 131:351–369 (1995).

Maxwell, I.H. et al., "Expressionof the Diptheria Toxin A–Chain Coding Sequence under the Control of Promoters and Enhancers from Immunoglobulin Genes as a Means of Directing Toxicity of B–Lympoid Cells," *Canc. Res.* 51:4299–4304 (1991).

McClelland, A. et al., The Human Transferrin Receptor Gene: Genomic Organization, and the Complete Primary Structure of the Receptor Deduced from a cDNA Sequence, *Cell* 39:267–274 (1984).

McLaren, C.E. et al., "Prevalence of Heterozygotes for Hemochromatosis in the White Population of the United States," *Blood* 86(5):2021–2027 (1995).

Miller, N. et al., "Targeted vectors for gene therapy," *FASEB J.* 9:190–199 (1995).

Miyazaki, J–I. et al., "Expression vector system based on the chicken $\beta$–actin promoter directs efficient production of interleukin–5," *Gene* 79:269–277 (1989).

Nolta, J.A. et al., "Transduction of: pluripotent human hematopoietic stem cells demonstrated by clonal analysis after engraftment in immune–deficient mice," *Proc. Natl. Acad. Sci– U.S.A.* 93:2414–2419 (1996).

Octave, J–N et al., "Transferrin Uptake by Cultured Rat Embryo Fibroblasts," *Eur. J. Biochem.* 123:235–240 (1982).

Oliveira, H.C.F. et al., "Human Cholesteryl Ester Transfer Protein Gene Proximal Promoter Contains Dietary Cholesterol Positive Responsive Elements and Mediates Expression in Small Intestine and Periphery While Predominant Liver and Spleen Expression is Controlled by 5'–distal Sequences," *J. Biol. Chem.* 271(510):31831–31838 (1996).

Omary, M.B. et al., "Biosynthesis of the Human Transferrin Receptor in Cultured Cells," *J. Biol. Chem.* 256(24):12888–12892 (1981).

Parham, P et al., "Arginine 45 is a Major Part of the Antigenic Determinant of Human $\beta_2$–Microglobulin Recognized by Mouse Monoclonal Antibody BBM.1," *J. Biol. Chem.* 258(10):6179–6186 (1983).

Parkkila, S. et al., "Immunohistochemistry of HLA–H, the protein defective in patients with hereditary hemochromatosis, reveals unique pattern of expression in gastrointestinal tract," *Proc. Natl. Acad. Sci. U.S.A.* 94:2534–2539 (1997).

Petrylak, D.P. et al., Transferrin Receptor Expression in Testis Cancer, *J. Natl. Canc. Inst.* 86(8):636–637 (1994).

Plank, C. et al., "The Influence of Endosome–disruptive Peptides on Gene Transfer Using Synthetic Virus–like Gene Transfer Systems," *J. Biol. Chem.* 269(17):12918–12924 (1994).

Raghavan, M. et al., "The Class I Major Histocompatibility Complex Related Fc Receptor Shows pH–Dependent Stability Differences Correlating with Immunoglobulin Binding and Release," *Biochemistry* 32:8654–8660 (1993).

Raper, S.E. et al., "Safety and Feasibility of Liver–Directed Ex Vivo Gene Therapy for Homozygous Familial Hyperchoesterolemia," *Annal. of Surgery 223* (2):116–126 (1996).

Rotzschke, O. et al., "Isolation and analysis of naturally processed viral peptides as recognized by cytotoxic T cells," *Nature* 348:252–254 (1990).

Ruddy, D.A. et al., "A 1.1–Mb Transcript Map of the Hereditary Hemochromatosis Locus," *Genome Res.* 7:441–456 (1997).

Schaeffer, E. et al., "Complete structure of the human transferrin gene. Comparison with analogous chicken gene and human pseudogene," *Gene* 56:109–116 (1987).

Schneider, C. et al., "Primary structure of human transferrin receptor deduced from the mRNA sequence," *Nature* 311:675–678 (1984).

Seligman, P.A. et al., "Isolation arid Characterization of the Transferrin Receptor from Human Placenta," *J. Biol. Chem.* 254(20):9943–9946 (1979).

Sugita, M. et al., "Cytoplasmic Tail–Dependent Localization of CD1b Antigen–Presenting molecules to MIICs," *Science* 273:349–352 (1996).

Uhlmann, E. et al., "Antisense Oligonucleotides: A New Therapeutic Principle," *Chem. Rev.* 90(4):543–584 (1990).

Vandewalle, B. et al., "Transferrin Receptors in Cultured Breast Cancer Cells," *J. Canc. Res. Clin. Oncol.* 110:71–76 (1985).

Voorhees, P. et al., "An acidic sequence within the cytoplasmic domain of furin functions as a determinant of *trans*–Golgi network localization and internalization from the cell surface," *FMBO J.* 14(20):4961–4975 (1995).

Wada, H.G. et al., "Transferrin Receptor in Human Placental Brush Border Membranes," *J. Biol. Chem.* 254(24):12629–12635 (1979).

Ward, J.H. et al., "Regulation of HeLa Cell Transferrin Receptors," *J. Biol. Chem.* 257(17):10317–10323 (1982).

Waugh, S.M. et al., "Isolation of a :Proteolytically Derived Domain of the Insulin Receptor Containing the Major Site of Cross–Linking/Binding," *Biochemistry* 28:3448–3455 (1989).

Weiser, P. et al., "Endosomal Targeting by the Cytoplasmic Tail of Membrane Immunoglobulin," *Science* 276:407–409 (1997).

Williams, M.A. et al., "Accumulation of Membrane Glycoproteins in Lysosomes Requires a Tyrosine Residue at a Particular Position in the Cytoplasmic Tail," *J. Cell Biol.* 111:955–966 (1990).

Wu, G.Y. et al., "Receptor–mediated Gene Delivery and Expression in Vivo," *Biol. Chem.* 263(29):14621–14624 (1988).

Zou, L. et al., "Isolation of a Liver–Specific Promoter for Human Growth Hormone Receptor Gene," *Endocrin.* 138(4):1771–1774 (1997).

Alvarez et al., "Inhibition of the Receptor–Mediated Endocytosis of Diferric Transferrin Is Assocaited with the Covalent Modification of the Transferrin Receptor with Palmitic Acid" *JBC* (1990) 265(27):16644–16655.

Alvarez et al., "A Point Mutation In the Cytoplasmic Domain of the Transferrin Receptor Inhibits Endocytosis", *Biochem. J.* (1990):267:31–35.

de Sousa, M., et al., "*Iron Overload in $\beta_2$–Microglobulin–Deficient Mice,*" Immun. Lett. (1994) 39:105–111 (0165–2478/94).

Rothenberg, B.E., et al., "*$\beta_2$ Knockout Mice Develop Parenchymal Iron Overload: A Putative Role for Class I Genes of the Major Histomcompatibility Complex in Iron Metabolism,*" Proc. Natl. Acad. Sci. USA (1996) 93:1529–1534 (National Institutes of Health).

Nierman, W.C., et al., "*ATCC/NIH Repository Catalogue of Human and Mouse DNA Probes and Libraries,*" Amer. Type Culture Coll. (1994) pp. 1–70 (ISBN 0–930009–56–8).

Abravaya, K. et al., "Detection of point mutations with a modified ligase chain reaction (Gap–LCR)," *Nucl. Acids Res.* 23(4):675–682 (1995).

Adams, M.D. et al., "Complementary DNA Sequencing: Expressed Sequence Tags and Human Genome Project," *Science* 252:1651–1656 (1991).

Amadou, C. et al., "Localization of New Genes and Markers to the Distal Part of the Human Major Histocompatibility Complex (MHC) Region and Comparison with the Mouse: New Insights into the Evolution of Mammalian Genomes," *Genomics* 26:9–20 (1995).

Anderson, J.R. et al., "Precipitating Autoantibodies in Sjögren's Disease," *Lancet* 2:456–460 (1961).

Bacon, B.R., "Causes of Iron Overload," *N. Engl. J. Med.* 326(2):126–127 (1992).

Barany, F., "Genetic disease detection and DNA amplification using cloned thermostable ligase," *Proc. Natl. Acad. Sci. U.S.A.* 88:189–193 (1991).

Balan, V. et al., "Screening for Hemochromatosis: A Cost–Effective Study Based on 12,258 Patients," *Gastroenterology* 107:453–459 (1994).

Barton, J.C. et al., "Hemochromatosis: The genetic disorder of the twenty–first century," *Nature Medicine* 2:394–395 (1996).

Beaucage, S.L. et al., "Deoxynucleoside Phosphoarmidites–A New Class of Key Intermediates for Deoxypolynucleotide Synthesis," *Tetrahedron Letters* 22(20):1859–1862 (1981).

Beggs, J.D., "Transformation of yeast by replicating hybrid plasmid," *Nature* 275:104–109 (1978).

Benton, W.D. et al., "Screening λgt Recombinant Clones by Hybridization to Single Plaques in situ," *Science* 196:180–182 (1977).

Botstein, D. et al., "Sterile Host Yeast (SHY): A Eukaryotic System of Biological Containment for Recombinant DNA Experiments," *Gene* 8:17–24 (1979).

Broach, J.R. et al., "Transformation in Yeast: Development of a Hybrid Cloning Vector and Isolation of the CAN1 Gene," *Gene* 8:121–133 (1979).

Chong, S.S. et al., "Molecular Cloning of the cDNA Encoding a Human Renal Sodium Phosphate Transport Protein and Its Assignment to Chromosome 6p21.3–p23," *Genomics* 18:355–359 (1993).

Cotton, R.G.H. et al., "Reactivity of cytosine and thymine in single–base–pair mismatches with hydroxylamine and osmium tetroxide and its application to the study of mutations," *Proc. Natl. Acad. Sci. U.S.A.* 85:4397–4401 (1988).

Church, D.M. et al., "Isolation of genes from complex sources of mammalian genomic DNA using exon amplification," *Nature Genetics* 6:98–105 (1994).

Clark, G. et al., "Characterization of a soluble cytoplasmic antigen reactive with sera from patients with systemic lupus erythmatosus," *J. Immunol.* 102(1):117–122 (1969).

Dausset, J. et al., "Centre d'Etude du Polymorphisme Humain (CEPH): Collaborative Genetic Mapping of the Human Genome," *Genomics* 6:575–577 (1990).

Edwards, C.Q. et al., "Screening for Hemochromatosis," *N. Engl. J. Med.* 328(22):1616–1620 (1993).

Faham, M. et al., "A Novel In Vivo Method to Detect DNA Sequence Variation,," *Genome Res.* 5:474–482 (1995).

Fahy, E. et al., "Self–sustained Sequence Replication (3SR): An Isothermal Transcription–based Amplification System Alternative to PCR," *PCR Methods Appl.* 1:25–33 (1992).

Feder, J.N. et al., "A novel MHC class I–like gene is mutated in patients with hereditary haemochromatosis," *Nature Genetics* 13:399–406 (1996).

Finch, C.A., "Hemochromatosis–Treatment is Easy, Diagnosis Hard," *West. J. Med.* 153:323–325 (1990).

Fischer, S.G. et al., "DNA fragments differing by single base–pair substitutions are separated in denaturing gradient gels: Correspondence with melting theory," *Proc. Natl. Acad. Sci. U.S.A.* 80:1579–1583 (1983).

Freemont, P.S. et al., "A Novel Cysteine–Rich Sequence Motif," *Cell* 64:483–484 (1991).

Grunstein, M. et al., "Colony hybridization: A method for the isolation of cloned DNAs that contain a specific gene," *Proc. Natl. Acad. Sci. U.S.A.* 72(10):3961–3965 (1975).

Gubler, U. et al., "A simple and very efficient method for generating cDNA libraries," *Gene* 25:263–269 (1983).

Gyapay, G. et al., "The 1993–94 Généthon human genetic linkage map," *Nature Genetics* 7:246–339 (1994).

Herskowitz, I. et al., "The lysis–lysogeny decision of phage λ: explicit programming and responsiveness," *Ann. Rev. Genet.* 14:399–445 (1980).

Hinnen, A. et al., "Transformation of yeast," *Proc. Natl. Acad. Sci. U.S.A.* 75(4):1929–1933 (1978).

Ito, H. et al., "Transformation of intact Yeast Cells Treated with Alkali Cations," *J. Bacteriol.* 153(1):163–168 (1983).

Jazwinska, E.C. et al., "Localization of the Hemochromatosis gene Close to D6S105," *Am. J. Hum. Genet.* 53:347–352 (1993).

Jazwinska, E.C. et al., "Haplotype Analysis in Australian Hemochromatosis Patients: Evidence for a Predominant Ancestral Haplotype Exclusively Associated with Hemochromatosis," *Am. J. Hum. Genet.* 56:428–433 (1995).

Jack, L.J.W. et al., "Cloning and Analysis of cDNA Encoding Bovine Butyrophilin, an Apical Glycoprotein Expressed in Mammary Tissue and Secreted in Association with the Milk–fat Globule Membrane during Lactation," *J. Biol. Chem.* 265(24):14481–14486 (1990).

Kan, Y.W. et al., "Antenatal Diagnosis of Sickle–Cell Anaemia by D.N.A. Analysis of Amniotic–Fluid Cells," *Lancet* ii:910–912 (1978).

Landegren, U. et al., "A Ligase–Mediated Gene Detection Technique," *Science* 241:1077–1080 (1988).

Levy–Lahad, E. et al., "Chandidate Gene for the Chromosome 1 Familian Alzheimer's Disease," *Science* 269:973–977 (1995).

Lovett, M. et al., "Direct selection: A method for the isolation of cDNAs encoded by large genomic regions," *Proc. Natl. Acad. Sci. U.S.A.* 88:9628–9632 (1991).

Maskos, U. et al., "A novel method for the parallel analysis of multiple mutations in multiple samples," *Nucl. Acids Res.* 21(9):2269–2270 (1993).

Matteucci, M.D. et al., "Synthesis of Deoxyoligonucleotides on a Polymer Support," *J. Am. Chem. Soc.* 103:3185–3191 (1981).

Maxam, A.M. et al., "Sequencing End–Labeled DNA with Base–Specific Chemical Cleavages," *Meth. Enzymol.* 65:499–560 (1980).

Miller, M.M. et al., "Immunoglobulin variable–region–like domains of diverse sequence within the major hitocompatibility complex of the chicken," *Proc. Natl. Acad. Sci. U.S.A.* 88:4377–4381 (1991).

Myers, R.M. et al., "Detection of Single Base–Substitutions by Ribonuclease Cleavage at Mismatches in RNA:DNA Duplexes," *Science* 230:1242–1246 (1985).

Needham–VanDevanter, D.R. et al., "Characterization of an adduct between CC–1065 and a defined oligondeoxynucleotide duplex," *Nucl. Acids. Res.* 12:6159–6168 (1984).

Needleman, S.B. et al., "A General Method Applicable to the Search for Similarities in the Amino Acid Sequence of Two Proteins," *J. Mol. Biol.* 48:443–453 (1970).

Newton, C.R. et al., "Analysis of any point mutation in DNA. The amplification refractory mutation system (ARMS)," *Nucl. Acids Res.* 17(7):2503–2516 (1989).

Nikiforov, T.T., et al., "Genetic Bit Analysis: a solid phase method for typing single nucleotide polymorphisms," *Nucl. Acids Res.* 22(20):4167–4175 (1994).

Orita, M. et al., "Rapid and Sensitive Detection of Point Mutations and DNA Polymorphisms Using the Polymerase Chain Reaction," *Genomics* 5:874–879 (1989).

Ørum, H. et al., "Single base pair mutation analysis by PNA directed PCR clamping," *Nucl. Acid Res.* 21(23):5332–5336 (1993).

Pearson, J.D. et al., "High–Performance Anion–Exchange Cromatography of Oligonucleotides," *J. Chromatography* 255:137–149 (1983).

Pearson, W.R. et al., "Improved tools for biological sequence comparison," *Proc. Natl. Acad. Sci. U.S.A.* 85:2444–2448 (1988).

Phatak, P.D. et al., "Cost–effectiveness of Screening for Hereditary Hemochromatosis," *Arch. Intern. Med.* 154:769–776 (1994).

Queen, C. et al., "Cell–Type Specific Regulation of a κ Immunoglobulin Gene by Promoter and Enhancer Elements," *Immunol. Res.* 89:49–68 (1986).

Raha–Chowdhury, R. et al., "New polymorphic microsatellite markers place the haemochromatosis gene telomeric to D6S105," *Hum. Mol. Genet.* 4(10):1869–1874 (1995).

Roberts, A.G. et al., "Increased frequency of the haemochromatosis Cys282Tyr mutation in sporadic porphyria cutanea tarda," *Lancet* 349:321–323 (1997).

Saiki, R.K. et al., "Primer–Directed Enzymatic Amplification of DNA with a Thermostable DNA Polymerase," *Science* 239:487–491 (1988).

Saiki, R.K. et al., "Genetic analysis of amplified DNA with immobilized sequence–specific oligonucleotide probes," *Proc. Natl. Acad. Sci. U.S.A.* 86:6230–6234 (1989).

Schneider, I., "Cell lines derived from late embryonic stages of *Drosophila melanogaster,*" *J. Embryol. Exp. Morph.* 27(2):353–365 (1972).

Simon, M. et al., "Association of HLA–A3 and HLA–B14 antigens with idiopathic haemochromatosis," *Gut* 17:3332–334 (1976).

Simon, M. et al., "A Study of 609 HLA Haplotypes Marking for the Hemochromatosis Gene: (1): Mapping of the Gene near the HLA–A Locus and Characters Required to Define a Heterozygous Population and (2): Hypothesis Concerning the Underlying Cause of Hemochromatosis–HLA Association," *Am. J. Hum. Genet.* 41:89–105 (1987).

Smith, T.F. et al., "Comparison of Biosequences," *Adv. Appl. Math.* 2:482–489 (1981).

Sprague, J. et al., "Expression of a Recombinant DNA Gene Coding for the Vesicular Stomatitis Virus Nucleocapsid Protein," *J. Virol.* 45(2):773–781 (1983).

Stone, C. et al., "Isolation of CA dinucleotide repeats close to D6S105; linkage disequilibrium with haemochromatosis," *Hum. Mol. Genet.* 3(11):2043–2046 (1994).

Strathmann, M. et al., "Transposon–facilitated DNA sequencing," *Proc. Natl. Acad. Sci. U.S.A.* 88:1247–1250 (1991).

Summers, K.M. et al., "HLA Determinants in an Australian Population of Hemochromatosis Patients and Their Families," *Am. J. Hum. Genet.* 45:41–48 (1989).

Syvänen, A.C. et al., "A Primer–Guided Nucleotide Incorporation Assay in the Genotyping of Apolipoprotein E," *Genomics* 8:684–692 (1990).

Taylor, M.R. et al., "Cloning and sequence analysis of human butyrophilin reveals a potential receptor function," *Biochimica Biophysica Acta* 1306:1–4 (1996).

Thiede, C. et al., "Simple and sensitive detection of mutations in the ras proto–oncogenes using PNA–mediated PCR clamping," *Nucl. Acids Res.* 24(5):983–984 (1996).

Vernet, C. et al., "Evolutionary Study of Multigenic Families Mapping Close to the Human MHC Class I Region," *J. Mol. Evol.* 37:600–612 (1993).

Wagner, R. et al., "Mutation detection using immobilized mismatch binding protein (MutS)," *Nucl. Acids Res.* 23(19):3944–3948 (1995).

Walker, G.T. et al., "Isothermal in vitro amplification of DNA by a restriction enzyme/DNA polymerase system," *Proc. Natl. Acad. Sci.* 89:392–396 (1992).

Wallace, R.B. et al., "Hybridization of synthetic oligonucleotides to φX174 DNA: the effect of single based–pair mismatch," *Nucl. Acids Res.* 6:3543–3557 (1978).

Worwood, M. et al., "Alleles at D6S265 and D6S105 define a haemochromatosis–specific genotype," *Brit. J. Haemot.* 86:863–866 (1994).

Wu, D.Y. et al., "The Ligation Amplification Reaction (LAR)–Amplification of Specific DNA Sequences Using Sequential Rounds of Template–Dependent Ligation," *Genomics* 4:560–569 (1989).

Yanofsky, C. et al., "Repression is Relieved Before Attnuation in the *trp* Operon of *Escherichia coli* as Tryptophan Starvation Becomes Increasingly Severe," *J. Bacteriol.* 158(3):1018–1024 (1984).

Youil, R. et al., "Screening for mutations by enzyme mismatch cleavage with T4 endonuclease VII," *Proc. Natl. Acad. Sci. U.S.A.* 92:87–91 (1995).

Yu, C–E. et al., "Positional Cloning of the Werner's Syndrome Gene," *Science* 272:258–262 (1996).

Gandon et al., "Linkage Disequilibrium and Extended Haplotypes in the HLA–A to D6S105 Region: Implications for Mapping the Hemochromatosis Gene (HFE)," *J. Hum. Genet.* (1996) 97 (1):103–13.

Seese, et al., "Localization of the Hemochromatosis Disease Gene: Linkage Disequilibrium Analysis using an American Patient Collection," *Blood Cells, Molecules & Diseases* (1996) 22:36–46.

Zecchinelli, et al., *Soc. for Neurosci. Abstr.,* Abstract No. 413.17 (1990).

Kamholz, et al., *Proc. Natl. Acad. Sci. USA,* "Identification of Three Forms of Human Myelin Basic Protein by cDNA Cloning", 83(13): 4962–4966 (1986).

Bernard, et al. *J. of Neurosci. Res.,* "Role of the c–myc and the N–myc Proto–Oncogenes in the Immortalization of Neural Precursors", 24:9–20 (1989).

Emerich, et al., *Cell Transplantation,* "Behavioral Effects of Neural Transplantation", 1:401–427 (1992).

\* cited by examiner

```
   1 CACACACACA CACACACACA CACACACACA CACACAAATG AGGTATATAA AGGGTCTCCT
  61 AAAATGTCAT CTGATATTTG TTATTTCATA TTCTCAGATT TTTAATCCAT TTAGGTAGGT
 121 CTATTTTAGA TAGCCTTGTC TGAAACAGAG CTGGGACCTG ATGAGTGAAA ATGAGCTCAC
 181 CAGAAGAAAA ATCAAACAGG CATTTCAGAG ATTGAGGCCA AGAAGTTAAA TGTCTTAAAT
 241 GGGCAGAGCT TAGCTGCTTG ATGTGAAAAG AGACCAGCGT GGCTGGAACA GCAAAGGAGA
 301 ACAGCAGAAG AGGTGAACAG AGGCCAGAGA TGGTCACTGA GTGGGCCCTT AAGTCATGGT
 361 AAGGAGTATG GAGAATGAAT TATTGCATGT ATTGAATATG TAGGTGACGT GACTCACAGA
 421 TACTTTGGAT TTGTAGAGAT GAAGGAAATG TAGCAAGTGA CACTCTTAGA ATGTTGATTT
 481 GAGTAAATGG TAGTGTCAGT TATTGAACTG GGGAGAACTG GAAGGGATAA CAGGCTTAAG
 541 GAGCACGTTT ATTCCTGTGT CTTGGAAGTG TTTAGGGTGA AAGACCTATT AGAGTTCTAA
 601 ATGGAGATGT CAAGTGAAAA TGTGGCTACA CACATTTGCA TTTCAGAAAA AAGGTCAGGC
 661 TGGAGATGTA AAATTGGAAG TTTACTGCAT ATAGATAGTC TTTGGAACCG TAGTATTGAT
 721 GAAGCCATTA ATGAGACAGA ACAAAGACTA GGGACCAGAG CCAAGCTCCA AGTTTCTAAA
 781 ATTTAGAGGA TAGTATAGTC TGGTCATTTT GAGGTGAATA CTTAATAACA GAACAATTTG
 841 TTGAAGTGTA AATTTAGAGC CCTACACTTT TAGCTCTGAC TATTAACGAA TACAGGAAAG
 901 AATGGATATG GTTATCTGCC TGGTGTCTGT GAAATAATTT AAGCCAGGAA GAGATCCTCA
 961 CCAGAAACTG ACTATGCTGG CAACTTGGAT CTTAGATTTC CAGCCTGCAG AATTGTTAGA
1021 AAATAAATGT CTATCGTTTA AGCCACCAGT CTGTAGTATT TTGTTATGGC AGTCCAAGCT
1081 GACTAAGTTT TGGTACCCAG GCGTGGGATG CTGCAACAAC AAATACCTAA ACATGGGGAA
1141 GTGGCTTTGG AAATTGGTGA TGGGTAAAGG CTGGAAGAGT TTGAGGTTCA TACTAGAAAA
1201 AGCCAATTGT GAAGGGACTA TTGAAAGAAA TATGGACATT AAAGGCAATT CTGGCAAAGG
1261 CTCAGAAAGG AAGAGAGCTG GACAGAAAGC TTCCATTTTC ATAGAAACTT AGATTTATAA
1321 CGATCATGGA TAGAATATTA AATATGCTGG TTAAAATATG GACTTTAGGC CAGGCGTGGT
1381 GGCTCACGCC TGTAATCTCA GCACTTTGGG AGGCTGAGGG CACAGATCAC GAGGTCGGGA
1441 GTTTGAGACC AGCCTGGCCA ATATGGCGAA ACCCTGTCTC TACTAAAAAT ACAAAAATTA
1501 GCTGGGCATG GTGATGTGCT TCTGTGGTCC CAGCTACTCG GGAGGCTGAG GCTGAAGAAT
1561 CGCTTAAACC CGGGGGGTGG AGGTTGCAGT GACCCAAGAT CACACCACTG CACTCCAGCC
1621 TGGGATACAG AGCAGGACTC CACTCCCCCC GCCACACACA CACAAAAAT ATATATATAT
1681 GGACATTAAA GTCAACTCTT GTGAGGTCTC AGATGAAAAT GAGGGACAGG TTATTGGAAA
1741 CTGTAGAAAT CACTGTTCTT GTTACAATGT GTCAAGAACT TGGCTGAATT ACGCTGTAGT
1801 GTTTACTGGA AAGAACTTAT AAGCAGTAAA ACTGGATATT TACCAGAAGA GATGTCTAAG
1861 CAAAGTATTG AAGGTGTGAT TTAGGTCCTC CTTACTGCTT AAAGTGAAAT GTGAGAGGAA
1921 AGAGCCGAAA TAAAGAAGGA ATTTTTAAGC AAAACACAAT CAGAACTTGG AGATTTGGGA
1981 TAGATTTCTC AATCTATATT GTAAAAATTG AGAAAGTTTT CTTGAAGAG GTATGGTTGA
2041 ACAATGTTTT CTTTTTCTTT TTTTTTCTTG GTTTATTTT TATTTTTATG TTTTTTGAGA
2101 CAGGGTCTGG CTATGTCATC CAGGCTGGAG TGCAGTGGCA CAATCTCAGT TCAGTGCAAC
2161 CTTTGCCTTC AGGCTCAAGC AATCCTCCCA CCTCAGCCTC CTAAGTAGCT GGGACTACAT
2221 GTATGCACCA CCACACCCTG GCTAATTTTT TGTTGTTGTT TATAGAGATG GGGTTTTGAC
2281 ATGTTGCCTA GGCTGGTCTC TAACTCCTGA GCTCAAGTGA TCTGCCCTCC TCAGTCTCCC
2341 AAAGTGTTGG GATTACAGGC GTGAAACACT GAGCCTAGCC TGAACAACCA TTTGATAAAG
2401 AGATAATGGG TGTGACCCAA GGATTAATC AGCCATCTCA GCAGAAGCCA GGAAGAGAGA
2461 TGGGATTATT CCAGCAGAGA CACTGCCAAT TTAAACTAAC GTAGGCAGAG AAAACAGAAA
2521 GGAACAAAGG AAGGTTGTCG ACTTTTGAA TTCTATAGAA CAGGATCATA GAGCTACCTG
2581 GCTGTCAATG TGTACTATTC TTTAAGAAAA GGAAAGACTG ACCCACCAAA GGCAACTTAC
2641 AAGATCACTA GGGCTGACTC TTTTGTTTTT TCTTGAGGCA GTCTCACTGT CACCCAGGCT
2701 GTAGGGCAAT GGTGTGATCT CAGCTCACTG CAATCTCCAC CTCCCAGGTT CAAGGGATTC
2761 TCTTGCCTTA GACTCCCAAG TAGCTGGGAT TACAGGCTCT AAATCTGTAC CCTCCCGAGT
2821 AGCGCTCCTG CCACCACTTG CCCAGCTAAT TTTTGTATTT TTAGTAGAGA TGGGGTTTCA
2881 CTATGTTGGC CAGGCTAGTT TGGAACTCCT GACCTCCAGT GATCCATTCT CATTGGCCTC
2941 CCAAAGTGCT GGGATTACAG GCAGGAGCCG CCAGGGCTGC CACTTTGATG TCAGACTCAG
3001 AGAGTACAGA TGGGATAGGG TGGGGTGGG AACATGTAGT CAAGGCTGAC TCTACCTGTT
3061 TCAAAGATGC CCTGCAGAAC TGTGTGGGAG TCTCTCACAG ATGGCTGCCT GGGTGGGACC
```

Figure 1 (Page 1 of 73)

```
3121 CCACCAAACT GAAAGACCGA GACTTCAGGC AGGGCAGATG GAGTAGGCCA ACTACAGAGC
3181 CAGAGGTGAC ACTGAGACAC CACTGGGCCT GGAAATCAGG GCATCAAGCC AAAGAGGGTT
3241 TTTCTTAAGA CCTAACAGAA TTTGCCTTGC CAGGTTTTGG ACTTGATTAG GACACATTAC
3301 ACCTTCCTTC TTTCCTATTT CTCCATTTTC TAATGGGAAT GTCTATTATG CCTGTTTCAC
3361 CATTGTACCT TAGAAGCATG TAACATTTCT GGTTTCACAC GTTCAAAGCT GGAAAGGAAT
3421 TTTGTCTCTG GATGAATCAC ACATTGAGCC TCACCCGTAA CCTGATTTAG ATGATTTTTT
3481 AGATGACACT TTGAACTTTA GAATTGATGC TAGAATGAGT TAAGACTTTC AGGGGGCTGT
3541 TGGGATGGAA TAATTTTTTT TTTTTTTTTG AGACGGAGTC TAGCTCTGTC GCCCAGGCTG
3601 GAGTGCAGTG GCACCATCTT GGCTCACTGC AAGCTCTGCC TCCCGGGTTT ATGCCATTCT
3661 CATGTCTCAG CCTCCAGAGT AGCTGGGACT ACAGGCGCCC GCCACCACGC CTGGCTAATT
3721 TTTTTTTTAT TTTAGTAGAG ATGGGGTTTC ACCGTGTTAG CCAGAATGGT CTCGATCTCT
3781 TGACCTTCTG ATCCGCCTGC CTTGGCTTCC CAAAGTGCTG GGATTACACG TGTGAGCCAC
3841 CATGCCCGGC TGGGATGGAA TAAATTTATC TTGTATGGGA GAAGGACATA CATTTTGGCA
3901 GGTCAAGGAC AGAATGTTAT GGACTAAACT GTGTCCCCCA AAATTCATTT ATTAAAACCC
3961 TAAACCCCAG TGTGACTGCA TTTGGACATA GAGCCTTTAG GGGGTACATA AAACTAAAGA
4021 TCACAGGATA GGGCCCTAAT CCCATTGGGG CTGGTGTCCT TACAGAAGAT GAGACACTTA
4081 GAGCTCTCTC TCCACGCAGG CACCAAGGAA ACACCATACA AACACACAGT GAGATGGCAG
4141 CCATCTGTTA GCCAGGAACA GATTCTCACC ATAAACTATG TTGGCACCTT GATCTTAAAC
4201 TTCCAGGCTC CAAAACTGTG AGAAAATGAA TTTCTGTTCC AAGCCTCTTA GATATGGAAA
4261 AAAAGATTCT GTTGTTTAAG CCATCCAGTC TCTGGTATTT TGTTATGGCA GCCTGAGTAG
4321 GCTAAGACAA TGAAGGATGT GGTAAAACTT TACGTCCCAA CCACATACCA AAGAGGCTGG
4381 AATTTAGCAT GCTTTCTTCT TTCAACTGTA GGCAATGTGC ACAAGTTCTA AATCCTAAGA
4441 CATGTTGGCT CCTTTACTCT GCCCAAACTA CAACTCAAAC AAACAACTGT AATATAATAA
4501 CATCCAATGA AGTTCTGACA TTTCTTCAAC ATGAGTACAG TAATTCAATG CCAGAGAATT
4561 CATTTTATTT TGAAATCTAC ATGCCATATT CCAATTTCTG TTGAAGATGC AATGGTTATA
4621 TTTATTCTTT TTAATATAGA TTTATCAGAC TGGGCGCGGT GGCTCATACC TGTAATCCTA
4681 GCATTTGAGA GGCTGAGGTG GGCATATCAC CTGAGGTCAG GAGTTTGAGA CCAGGCTGGC
4741 CAACATGGTG AAACCCTGTC TCTACTATAA ATATAAAAAT TAGCTGGGTG TGGTGGTGCA
4801 TGCCTGTAGT CCCAGTTACT AGGGAGGCTG AGGTAGAATT GCTTGAACCT GGGAGCAGGA
4861 GGTTGCAATG AGTGGAAATC GCACCAGTAC ACTCCAGCCT GGATGACAGA GCAAAATAAT
4921 AAATAAATAC ATAAAATAGA TTTATCAGTT TATCAATAAT ATAGTTTTCT TTTCTAGGTG
4981 TAAATATAGG TAATGACTGT CCTTTAGTAC ATTTTCTCAT GATGCTCCTC TTACTTGGTT
5041 TGGTACAATA TTAAGTATTG AAATAAAATA GAGAATCCTG TCGCTACACA TGAGCACTTA
5101 TTCCATTTGC TCATCTCCAA TATGCACGGG AAATTCTCAA ATTGCTAATA ATCTTGTAAC
5161 ACACATGCAT TATATTCAAC AGGAATATAT AAATTTATAA TTATAATTTA GGATCAACAG
5221 ATGACAAACC TTTAGAAGGT TTGTATTTAA CCTTAAAATA TAATTTTTTA AAAATTGGTT
5281 ATAAAATTTC TAATACTTTC TTTTTTGTGA CCTCAAGGGG AAAATATAAT TCTTATAAAA
5341 GTTCAAATGA TTTACAGAAT ACAAAAGTG AATAGAGATG ATGAATGAAT TAAAGGAAAG
5401 GATATTGCTA CATAGATTTG GAAATTTAAA AAGGGAAATT ACGATTGTTG ATTTTGTGTT
5461 AAACTGATCT GCTTTGTTCA AGATACCTTA TGTACCAAAA AATGATTTTA TCTCAGCCTC
5521 ATATCTCAGT AAATTCCTGA GACAAACTTT AGTCCCTGGT GCCCAGGTGC CTTTGGTAAT
5581 TGGGAGACCT CTAGGTTTAG CATCCTCATC CACTCGCCCC AATTTAAATA GTCCTCCCCA
5641 GGGCCATTCA GGCAAGGGAG ATGAAAACTT GCTCAAGAGT TGGAATCCAA CTGAAGCTAC
5701 CGAAATTCAT TGCTCAATAG ATAATTTTCC CTGGAAGTAA CTAGGGCTTT TGAATATAAT
5761 AGTGGGCATT TCAAAGTAGA AGGTAAAGTA TTTTGGAGAT GAGGAGACAG GACAGAGCTA
5821 CGAGGAATGT CCTTTGCTTA GGGACTAGGC TCTTAGCAGT ACCTCTTAGG TAAGAACTGG
5881 TTAACTGGCA CCTTCTGTGT TTCTCTGAAG CTCCCTTTGC TTAGGGACTA GGCTCTTAGC
5941 AGTACCTCTT AGGTAAGAAC TGGTTAACTG ACACCTTCTA TGTGTCTGAA GCTCCCAGAA
6001 CAAACTGCCA GTGAAATTTG GATTTTGGA ATATAGTTTC TTTTTTCTTG TTACTTTTTG
6061 TTTTGTTGTT TTTTTTGAG AGTCTCACTC TCACTGCAAC CTCCCCCTCC TATATTCAAG
6121 TGATTCTCTT GCCTCAGCCT CCCGAGTAGC TGGGACTACA GGCGTGCACT AGCATGCCCA
6181 GCTAATTTTT GTATTTTTA GTAGAGATGG GGTTGGTTTT TTTTTGAGAC GGAGTTTCAC
6241 TTTGTCGCCC AGGCTGGAGT GCAGTGGCAC GATCTTGGCT CACTACAACC TCCACCTCCC
6301 GGGGTTCAAG TGATTCTTCT GCCTCAGTCT CCTGAGTAGC TGGGACTACA GGCGCCTACA
```

Figure 1 (Page 2 of 73)

```
6361 GGTGAACACC GCCACACCTG ACTAATTTGT GTAGTTTTAT TAGAGATGGG GTTTCGCCAT
6421 GTTGGCCAGG CTGGTCTCAA ACTCCTGACC TCAGGTGATC TACCCACCTC AGCCTCCCCA
6481 AGTGCTGGGA TTACAGATGT GAGACACCAG ATCAGCCTCA GAAGACATTT TCTATTGGAA
6541 AGAGAAAACA CTATTAGCAA CCTATTAGTC TAATATTTAA TACTTAATGT CTTCCTTAGT
6601 AATAAACCAA CTCTCTACAA CAAAGTGCTT CCTGGCTGCC TAAGTCATTG ATTCATTCAG
6661 TTCAACATTT TCTCAATGCC CAACAGCCAA GTGTCTCTTG TATGCCAAGT TCTATGCTGA
6721 TTATCAGTAT TTGAATAAGA GGGGGTCTAC ATCTTAAGTA CTGCTTAAGA TGAAAGCCTC
6781 TAGGTTAACA AACTTAACAC AATGTATCAT TCACTACTAA ATAGACCGAA TACAAAATCT
6841 TGTTATTGGA GCCCAGAGAG AAGAATTGAA ATTCAAGTTT TCTCTCTCTC CTTTTCTCAC
6901 TCACCACAAT AAGTCAGTTG CACCAAGTCT TGTAGCTCTT TACTGAGCCA TGTTTTCACG
6961 TGTCCCTTTG TTTTATTTGC CACACCCTAA ATAAAAATTG TACTGGCTTT TTTTCCCTGG
7021 GTTTACAGTA TTAATACATT GTCAAGATTT ACCTCTTCGT GTAGATTCCC TGGGGAAAAT
7081 TACCTTTCCT CCTTCCCTTA AATTCTTCAG AGGTTAGAAA GCCATTAGTA ACATTCTGGT
7141 ATGTGGACAA AGTTTACCCA TTATGTATGG ATGTTTTACT CTTTCTATTT TTCTGACAAT
7201 AATCTCTTAA GGAGGTGTGG TTATAGAATA GTCAGCTGTT ATAAGTACTG TTTTCCTGGC
7261 CTTACAACTT AAGTTCTTTA AGCTGTTTCT TAGTTTGCTC ATCTCAAAAT TCGGAATAAG
7321 GATAAAACCT ATCTCTTAGA TTGTTGGATT AAATGAATTA ACATACTGGA AGCTCATGAA
7381 ATGTGCCTGG CACACAGTAG TGCCTAATAA ACCATCTCTC TTATTCAGCC TGTTTTCTGA
7441 TTTCAGAATC TACACTTGCT GAGCCAGGTT CTTTTCATTT CAAGGTGAGC AAAAGCATAC
7501 AAGGAAGAGA TGGAGGTAGG AAGAGATTAA GCCCTAGGCC AAGGTCACAC ACCGATTGGG
7561 AGCTGGAATC AAAGGCAATT TGGTCAGTGA ATAAAAAGGA TTCCAAGGCC CATAAGGCAA
7621 TTCTAACCTT AGGATCGAAA TTCTCGGACA TACAGGAAAT GCTGGGGGGG GAAAATCCGG
7681 TCTTCTCAGC CCAAGAGCCA TGTGAAACCA GACCTTCAAA TCTGATGATT CTCAGCCCAG
7741 CTGCCCATTA GAATCGTTGT AATTTAAAAA TACCCTCGGA AAATTCTAAT ATGTGGCTAT
7801 CAAAGGTGAT CATTTGCTTT TATGCCACTT TGTTTTCACC CAAATGGGAC ATCCAACCCT
7861 TTTCCTTTGA GAGTAGTTGT AGGGAAAGGA GGGGGTGGAG GGAGGGAAGA GCGGAAAAGG
7921 CTGGATCCGC CCTGAGCCGG TGTCAGTATC TGGGAAGTGG GAGGCGCGTC AGCAGTAAAC
7981 AGCTTCTGCT AGGATTATTA TCTCCTGCCA CACACTCGGA TTTGAAGGCT CCAAACGAAA
8041 CAATGCAAAA CGCTTCAGTG GAGTTCCAGA AGCGTTAGAC TAAACGACTG GGTCTGTTTG
8101 GCCAGTCTGA GCAGCTGGGC GCAGATGCAT AGGCAAGACT TAGCCCGCCT AGACTTTTCT
8161 GCCCACTTAA TTCCGATCAA AGCAGAAACC GGCCGGGCGC GGTGGCTCAC GCCTGTAATC
8221 CCAGCACTTT GGTAGGCAGA GGCTGGCGGA TCACCTGAGG TCAGGAGTTC GAGACCAGCC
8281 CGGCTAACCT GGTGAAACTC CGTTTCTACT GGTGGCGGGC GCTTGTAATC CCATCTACTA
8341 GGGAGGCTGA GGCCGGAGAG TCGTCTGAAC CCGGGAGGCG GAGTTTGTAT GCAGTGAGCC
8401 GAGATCGCGC CACTGCATTC CAGCTTGGGC AACAGGAGCA AAACTCCGTT TCAAAAAAGC
8461 AAGCAAACAA ACAAAAAAAT GCAGAAACCG AGATCCGGAA GAAAACCTCG GCGAGATTCA
8521 CAGAATCCAG GAAAATAGGT CTCTAGAAAT TTGTCCATGG TCCCAGATCT CCATTTCTTG
8581 TGGGTGGGGC AGCTGTTACC AGATCCCTAG AAGCAAAGGT TTTTTTGGGG GACCGTGTCT
8641 CACTGTTGCC CAGGCTGGAG GGCAGTGGCA CGATCTCGGC TTACTACAAC CTCCGCCTCC
8701 CAGGCTCAAG CGACTCTCCT GCGTCAGCTT CAAGAGTAGC TGGGATTACA AGGTATGTGC
8761 CACCACGCCC AACTTATTTT TTTATTTATT ATTTTTATTT AGTAGAGAGG TGTTTCACCA
8821 TGTTGGCCAG GTTAGTGTCG AAGTCGTGAC CTCAGGTGAT CAGCCCCCTC GGCCTCCCAA
8881 AGTGGTAGGA TTAGAGGGGT GAGCAGAAAG CAAAGGTTTT TGAGTGGCCA CAGGCCCCAC
8941 TCTATTTCCT TTTCTGCCTG TAATGGCAAC CTAGACGCTT GAGCTTCTTA AAATACAAGA
9001 GTAAGTTGCA TGTCAGGCAC CGTTCTACAT TAGGGACATT AGTCTGTTTT ACAGACACCT
9061 TTCAACTCCC TGGTTAACTT TTAGGTAATA TACTCTGCAC TTTAGCAGGA ATGGGACCTA
9121 TAACTCTCAC AGAATTAGGA AAGTGAGGCT GCCTACAGCC TAAATTGAGA AAAAAATAGA
9181 CGGGGACTA GTCGGAGGAC CAAACAAGGT TACCAACACG TTAGAGTTTT GCCTTCAATT
9241 TACATTTTTA AAGTAATCAC AACGAAGTGT TTAGATCACG AGGCATCCCT GCATGTAAAC
9301 TGTTAGGCAC TAACTATGGT CGATCTTACA AAGCATTAAC TAGAATATTT CTTTAGAGTA
9361 TGATAGTACG TAACTGACCT ACTATTACAT ACAAACAGAC CAACCTTTAG TAACAGCGCT
9421 CCCCAAAAAC CGAAAAGCAG TAATACGCTT TGCTCAAGGT TGGCATAAAA TTAACTTACC
9481 TTAGTGCCTT TTTTCCTTCT ACCTACAAGC AGTGAGGTTA GCTCTTCCTT TGAAACGGTA
9541 GGGGGGCTCT GAAAAGAGCC TTTGGGTTTG ATAGCGTTTC CGGGAGCTCA GATACCTGTC
```

Figure 1 (Page 3 of 73)

```
 9601 AAATCACTTG CCCTTGGCCT TGTGGTGACT CTCGGTCTTC TTAGGCAGAA GCACGGCCTG
 9661 GATGTTAGGA AGGACGCCGC CCTGAGCAAT GGTCACCCGG CCTAGCAGTT TGTTGAGCTC
 9721 CTCGTCGTTG CGGATGGCCA GCTGCAAGTG GCGCGGGATG ATGCGAGTCT TCTTGTTGTC
 9781 GCGAGCCGCG TTGCCGGCCA GCTCCAGGAT CTCGGCGGTC AGGTACTCTA ACACCGCCGC
 9841 CAGGTACACC GGCGCGCCTG CCCCAACCCG CTCTGCGTAG TTGCCTTTAC GGAGCAGGCG
 9901 GTGCACTCGG CCCACCGGGA ACTGGAGACC AGCGCGAGAA GAGCGGGATT TCGCTTTGGC
 9961 GCGAGCTTTG CCTCCTTGCT TACCACGTCC AGACATTGCA ATCAGACAAA AATCACCAAA
10021 ACCAGCGGCC TAAGCTCACG AGAAAACAAA CAAAATCAAG AAATATGTAA AACATGGCCG
10081 CTTTTATAGG TAGTTCCTGG GGAGTAAATC CGACTTTTTG ATTGGTCGGT AGCAAATGCT
10141 AGTCAGATAG CCAATAGAAA AGCTGTACTT TCATACCTCA TTTGCATAGC TCTGCCCACG
10201 GATGACAACT GTGCAGTTTG TCTTCCAATT AACTAAGAGG TACTCTCCAT CCCTCATTAG
10261 CATAAAAGCC CTATAAGTAG CAGAAATCCG CTCTTTACTT TCGACACATT TCTGGTGTTT
10321 TAAGATGCCT GAGCCAGCCA AGTCTGCTCC CGCCCCGAAG AAGGGCTCCA AGAAGGCAGT
10381 GACCAAAGCG CAGAAGAAAG ATGGCAAGAA GCGCAAGCGC AGCCGCAAGG AGAGTTACTC
10441 TGTGTACGTG TACAAGGTGC TGAAACAGGT CCATCCCGAC ACTGGCATCT CTTCCAAGGC
10501 CATGGGCATC ATGAATTCTT TCGTTAACGA CATATTTGAG CGCATCGCGG GCGAGGCTTC
10561 CCGCCTGGCG CATTACAACA AGCGCTCGAC CATCACCTCC AGGGAGATCC AGACGGCCGT
10621 GCGCCTGCTG CTTCCCGGAG AGCTGGCCAA GCACGCCGTG TCGGAGGGCA CCAAGGCCGT
10681 CACCAAGTAC ACCAGCTCCA AGTAAACATT CCAAGTAAGC GTCTTAACAC CTAACCCCAA
10741 AGGCTCTTTT AAGAGCCACC CAGATACCCA CTAAAAGAGC TGTGGCCAGA CGCCAAATTT
10801 TATTTGGCGG CGGAGGGGTA TTAGAATATA GGAACTGGAG AGGGGTGGGG ACAAGTGTTG
10861 CAGCTTAGAG AGGGACAAAG GGTCCTGAAC CCGAAAGAAG CCAGCCATTA AAAATGGCTT
10921 TGGGGTCAAT TCGTTGTGCT TAAATTTAAA ATGGAGACAA GCGGCCATTT TGCTAACTCG
10981 GCGTTCCCGG AAGAAACCGC AGGCTCGCTT AGGTTTCAGA CCCAGCTGTC TGTCCCTGTC
11041 TACGTCGCCA GGATCAACGG TTGCCGTAAT GTCATAATTT CGCCACCAGC TTCTAGCCAA
11101 TAGGCTGTCC TGTCATTTTA AATATTAACC AATCGAGGGA AAGCTGTTTT GAGACTCTGA
11161 TTTACATAGC GGACCGGAGT GGGAACCTGG GCAGTAACTG CCTAAGGAAG GACTCCCCCT
11221 CTGTTTTCGT GGCGCACACC TTCGTAGTAT ACTGAAGGGT GTGTCTCCTG GGTTTCCAAC
11281 TGCCCCGGTA ATAGTCTTTT AACCTAATAT GCGTCAGTTT TGATAACAAC ACTAAGGCAG
11341 TACAGAACTA AAGATGTAAG CACTGCGCCA GATGTTGCTT CATACATCTT ATTCTATTCA
11401 ACTGGTTTAT TCAAGATTCA AATCAAATCA AATTTTGCTT GAATCCCAGT GCTCAGTCAG
11461 CCATAAATGG TGTGTTGCCT GATTGAAACT TAAAATCTCC GTAGGGGGCT TGTAACATGC
11521 AGACAAGTTT GAAAGTTGCT TTAGGAGAAG CCAACTCTTA ACTGCTGGGT AAATTGACAA
11581 GCCTTCGAAC ACTGAACTGA AGGCCAGTAA GGACTAGGCG CTGGGTGGGG GAGAATGAAG
11641 AGGAGACGTC ATTAAACTTA GCACATACAC TGTATCTCCT AGAGGACTCT CCCTTCCTAG
11701 ACAACTGCAG GCCGCTTTGT GGCCTGGGAA ATTCCACATT CCCTTAAGTA TTTTACTCAT
11761 GGTCTTTTCC AGGTAAAGAT TTTAAGATGA AGGGTTAGAC GTAGTCTACC TATCTTTTTA
11821 TTCAAGTCTA GAACACGTTT TTAGCACCTA GAAGTTTGCT TTCTCCATTA AAAACCGGGA
11881 ATATACAATA AATAAAATTA GTGTTAAAGC AGATTTTTAC AAACTTAAAT ACCATGTAAT
11941 TTAGGTTACA GTTATTTAAC ATAAGGACTG TGTGATCTTA AATCTGCAAT TTCTTTCACA
12001 CCTGGGAAAT AAACTAAGGC CTGTCTTTGG TGCCAGACAA GGCCTTATAC TTGAACACTG
12061 CTGTGCAATC ACAGGCTGCC TTGCCTAGAT AACTTATCTG AGAAATTCTG ATGAGAAATG
12121 AAATTTCCAG AGTCCCTCAC AAGTAAATTT TTTTTTCTTT TTTTTTTTTT TTTTGAGAC
12181 GAAGTTTCTC TCTTGTTTCC CAGGCTGGAG TGCAATGGCG CGATCTTGGC TCACAGCAAC
12241 CTCCGCCTCC CGGGTTCAAG CCATTCTCCT GCCTCAGCCT CCGGAGTAGC TGGGATTACA
12301 GGCATGCGCC ACGACACCCT GGCTAATTTT GTATTTTTAG TAGAGACGAG GTTTCTCCAT
12361 GTCGGTCAGG CTGGTCTCGA ACTCCGGACA TCAGGTGATC TGCCCGCCTT GGCCTCCCAA
12421 AGTCCTGGAT TACAGGCTTG AGCCACCGCG CCGGGCCTAA ATGGTTTTTT TTTTTTCTAT
12481 GCCTCTAATG GACCTGGTCA CTTATTCCCA TTCAGACTGA CCGCTCTCCT ACCTGCCAAC
12541 TAACTAATCA GTGTAACCAA AATCTGCAAA CAAAATTCAG TATTCTTTCC CCGCCTTTTC
12601 CCCTTTCTCT TACATAGATT ATGTTTTTGC CTGTGTTAGA TGAAATAATT CTATTGCTTG
12661 TTCTCTCTTC TGTACAAGTA CCCAGTAAGC AAATTATTAA CTTCTTGGTC ATTTATTTCT
12721 GAATTTTCCA CCAAGACAGT GTTTATGTGA GTCATACAAT AAGAACCAAC AGAAATGTGT
12781 GTCTTGGAAA CAGGTTGTCT ATCCCTGGAC CCTTTGAGTT TTCTGTTCAC TTTCCTTTGG
```

```
12841 CTTTTGCATG CTAAAAGTTT ATCGTCCGCG TTTGTTTGTT TTGGTTATTC TAATTGGACT
12901 TGGCTGATTG GTTGCATATT GGTGGCAGTA GTAGAATTTG AATTCTGGTT TTCTGGTCAC
12961 ATCATTAAGT GATTAGTCAG TGGAGAGGAC AGGAAATCTG GTTTATTTAT TAACCTTTTT
13021 TTGGGGTGTT TTTGTTTGAA GATGTTGATA TTCTCTGTGA GGACACAGGG TTAGAGTTGG
13081 TGTTTTTCTT TCTGACTTTA CATGGGATTT GATGTTTTGT GCTTGTATGC CTCTTTCCAC
13141 CTTCCAAAAC TTGTCTTTTT TGAGTCCAAA TAGTTGTCGA TATCTGCAAA ACCAGTATTC
13201 CTGTGTTAAG ATGATATGAA TATAAAATGG CTGCCCTGTT ATAACTTTTG ACTTTAAGAA
13261 AGTGTTAGGA CTAACAGGAG ACAAAAAGGA AATCAAGGAA ACCGAATGTC TGGTCTCAAT
13321 AACTGCTATG GCAGAGGCTC TACAGCTTAT TATTAATTTT AGTAATTTCA CATTATTGCC
13381 CCTTCACGTT CTTTAAGTAA GGTTAGAGGA CAGAAGAAAC ATAATGTTGT TACAAATTGG
13441 ACTATTGAGT CAGGGAAAAA AAAGAGTGCT TTCAATATCT GAATAAAACA AAGATTTAAT
13501 ATTTTCTAAA CCTTAACGAG TTTATTGTAA GGGATGTGAT GCTGGAAACT AGGAAACTAG
13561 AATTTTCTTC TAAACTGAGA ATCAGAATTA TTCATATTCT CAGCAGTGGT GCCACCTGAG
13621 GGACTTCTGA TCTTAATTAC ATACTTTTAT TTCTTTAACT GATCAACATG CTAAATAGAT
13681 AACCTATGGC TCTGTTTTTA CCCACTTTAA ATTCTGTTCT ATTAGCACGG TTAGCTTTCC
13741 TAATTGGCAA TAAGATTGAG ACTATCTTTT TTTTTTTTTT GAGACAGAAT TTGCTCTGT
13801 GGCCCAGGCT GGGGTGCAGT GGCACAATCT CGGCTCACTG CAACCTCTGC CTCCAGGGTT
13861 CTAGCAATTT TCCTGCCTCA GCCTCCCCAG TAGCTGGGAT TACAGGTGCA CCACCACGCC
13921 TGGCTAATTT GTGCATTTTT AGTAGAGATG GGGTTTCGCC ATGTTGGCCA AACTGGTCTC
13981 GAACTCAGGT GATCCACCTC GGCCTCCCAA AGTGATGAGA TTACAGGCGT GAGCCACCGT
14041 GCCCAGAAAA GACTATCTTA TTTTATGAAT TTAAATAATT GTGAAATTAT CCACTTAAGG
14101 GAATTAATAA ATTATAATGT AATCTTAAAT TTTAGTTGGC TTACATAAAG ACTTAAAATA
14161 CATCAATTTA AATAAAAACT CATTTGTCTA AAAAAAAATC AAAAATTTTC CTTGTGCTTT
14221 AAATGTGCTA CCTCTTTAAG TTCTAATTAA GAGAAAAAAA GTTTAACTGT GAGTTTCATT
14281 AGTGGTCTTA GTTAACAGCT TAAAGTATTT TGTAAAAAAA ATACTTCACA ATTTTTAAAT
14341 AACTTAAAAA TATTAATACC TCTTTTATTA GGTTTTTTTA ATAAGGAAAA TATATAATAC
14401 ATCTAATCAA GATTTTTTTT GGACAAATTG GCTTAATAAT TTCATTTTAA AAATGGCTTC
14461 TTTATTCTTA TACTGTAAAA ATAATATTAG CAGAATATTA TAGTATACAC AAGTTTAGGG
14521 TTCATATTCT AAAAAACAAA AACAAAAGCT AATTTAACTT GCATTTACTA AATTTCTTCC
14581 ACTAGTTGTA CTGGTTACAT GAGTTAACAT CACTTTATTT ATTATTCTAA AATTGTAAAT
14641 TATTCATTGA ACCAAATTAA ATGATAATAG ATAATGTCAT TTTTAAAAAT GGAATTAAAT
14701 TTTATGTTAC TAATTATAAG GATTCAATGT GTGAGCTTAA GTACTGAGTT CACAGTGTAT
14761 GATAACTTTA AGAATTTAGG TGAATATTAT TAAATTGAGT AAATTAATTC TCAATCTTTG
14821 GATACCTGGA CAATTTCTAA ATTGGAGGGT ACAAAATACA AATCACAAGA AACAGTGTAG
14881 TTTTATGCAA ATAACATTTT TACACAGTTT AGAATAACCA TTGATAAACA GATAAGAGAA
14941 CATATGATTG CCTTAGAATA GATACTGTTG CTTTCGCCAC TTTAGATTTG TAAATCACGT
15001 ACTGTATACG TGTGGGCGTA GAGGACCATG CAGGTTTTGG ATGACTGCCT CTGTTTTCGT
15061 CATGCCTATG CGGGAACACA ATTGCCTGCT TTGTTTAAGG GCTATGGTTA ATCCAAACAG
15121 CTCTGACTCT ATCAAGTACT ATAGCTACAG AGAAACACAA GTAAGCATTC GAGATAATGA
15181 CTACCTTGAG CCTTTACTTA TTTAAAAAGT TGTTACTGTT TGTTAATGTG GTACATTCAA
15241 TTTACTATGG ATTGTCACTC TAAAATAAGA CTTCAATCTT TTTCTTATTT TTATATAGCC
15301 ATGATTTATA TTCATATCTT AATGTAATAA CCAATCTTCT CTGACAACAT TATAACAATG
15361 CTGGAACCTC CATTTTCAGT ACTTCAAACA ACAAATACTG CTTTTATACT TCAGAGCAGA
15421 TGGATATGTG CTTCCCAGTG TAAACACATT TGGAATCTCA CTGAGAAATA CACTATCACT
15481 AAAAATACAG TTCTGAGATT CATTAAAAGA CCTCCAGAAT TCTGGAAGTA GGAAGTTTCC
15541 TCTTCAAAGT CTACAGAGGA AGATGAGGTC TGAAATAGAC AGCTTCTTCC TTCTTTTACC
15601 TGTGGTATTA TTCTGTTTTG TCCTTTTCTC CATTATCTGT CTTTCCAGTG ATGAAATTTT
15661 GATCTGGCCC TCCCAAGTAT TAAAAAACAA GCAAATAAAC AAATCTCAGT TATATTTTAC
15721 TAAGATATTG GCATGCTAAC TTTTTGCAGG TTTGTAACAA GGACCTTTAT AACTTGACTA
15781 AAAGTTCCTA AATAAGAATA TTTACTAGAA AATTTATTTC TGCCTGTGGC CCACATTTGA
15841 GTCAAAATAA TCAATTAGGA AAAATGAACT TGTTTAACTA AGTTGACCA AACTGATCTT
15901 TGACCAAACT GATCTTTGAG ACCTATTCAT CTAAGACAAG CCAATTAAAT TCTTGGAGAC
15961 AATTTGTACT TTAAGGAATT CTTATAATAT TTGTAATTAC CCTCATAACT TTTTTTTTTG
16021 CCCTACTTCT GTGCTTCTCT AATATGCAGA TTATTAAATG TTGTTACAAA GCCATTGTCA
```

Figure 1 (Page 5 of 73)

```
16081 AAAAAACAAA AAACAAAAAA CTAAACAAAC TCACATGGTT AGACTTGCTC CTTTATGAGA
16141 TATTTTTACC AAAAATGGAG GAGTTGAAAA ACTCTGGTGC CAGAAATCGT GAAGACATGG
16201 CCTACCTAAC ATGGAAATGT TGGTTGTCAG TGGAAAATAC TACACAGAGA TAGCCATAGT
16261 GCTGCACAGC CAATCTTAAG TGTTTCTAGA GAATCACTAA TTGTTTCTAG AGAATCACTA
16321 ATTGTTTTCT TTTAACATTC TTGGTTTATA CAAGAAGAGA GTATCCATAC TAAACTCTTT
16381 TCTACTGAAA ATAATGTGCA AACATAACAT CCTATTCCTA GACAGTTTGT AGTTTTTTC
16441 TCCCATTTCT ATTTTATAAA TCATCTTTTT AAAATACTTT GTTGAGTGAA ATCAGTCCAT
16501 TGCTTGATAT ACCTTGAGCA CAAGTAAATA GTATGCCAAA AATTAAATGT CTTTCAGTCA
16561 CAGTTTGACA AACTCAACTA CCCTGAGCCT ATAGAGTGGT AATAATTGCC CTACTCATAA
16621 AGATGGGGTG AAGATTAAAT GAAATAGCAC CTATAGAACA CTAGTTCCAG ACGTGGTATC
16681 ATGCTAGTAA AATGGCTGCA CAGCACTGCT CAATGATGAC AAAAAGTGAA GCTTCTGGAG
16741 ACAGACTCCA AGTTTGACTC CCAGATCACC ACATATAAGA TGTGGGACTC TGAGGCAGGT
16801 CATTTAATCT CTCTGTGCAT TAGTATCCTT CTCTATACCT TTACAGTGAT GGTAATAGCA
16861 CCTACCTTCT AGAAGTATGT GAAGATTAAA GATCCTTAAT GCATATAAAC CACTGTGTTT
16921 ACTGCTGTTT GACAAATTTT ATTTATAACC ATCTTTACGC TCCTAAAAGG ACTTGAAGCA
16981 GCTTATGACT GAAGACTTTG GTAGGAGTTG GCCTTCTATA AATTATAAGA ATTTCATAAA
17041 TTATTTGATA TGAAAATGCC AGTTGATCAT AGTATGTTTA CCGGGGTCCA ACAGGTTGAG
17101 AAAAAATACA CTTTTTTTCC CTGAACATAT GAAATTAGCT CTCTAGGCAT ATTCCTAAGG
17161 ACTTAAAGAA TGATAACTAT CATTTCTCTT AAATCTTCCA GATTTGGAAG GATATATATA
17221 TTCAGCACAT TGACAGACAA TCCCAGTAGT CCTAAATTAA AAGACATTAA AAATTAGTGA
17281 AACTTTTCCT ACCTTTAGCC TGTGTAATCC TGGATGACCA AGCATAAAAT TAAATTGAGT
17341 AGAGTATACC ACTGTAACAT TTCCTGAAAG GTATTCTAGG CTCTGAGTAA TTTCTTTGGG
17401 GTCTGAAGAT CAGTTTGACA TATCCTCAAG TATCATGAGT TCATTATAAT TAAGAAAAAG
17461 AGAGTAAATC TGGAGAATGA GCCACTTTCT TACTACTCCT TGACCTCAGT TCTTTTTTTC
17521 AGAGACAGGG TCTCACTTTG TTGCCCAGGC TGCCAGGCTG GAGTGTAGTG GCGCAATCGC
17581 ATCTCATTGT AACCTCCACC TTCTGGGCTG AAGCCATCCT CCTGCCTCAG CATCCTGAGT
17641 ATCTGGAACC ACAGCAGGTG CACACCACCA TGCCAAGCTA ATTTTTAAA AAGTTTTTG
17701 TAGAGATGGG GTCTTACTAT GTTGCCCAGG CTGGTCTCAA ACTCCTGGGC TTAAGTGATC
17761 CTCCTGCCTC AGCCTCCCAA ATTGTTGGGA TTACTAGTGT GAGTCACTGT ACCCCGCCCC
17821 ACTTCAGTTC TGAGGAGGAA AAAATATGTA ATAATAATGG GACTTTGGTT TGCTGATTTA
17881 AAGATTCATG TAACCTTATC ATCCAATGCG CAATTTGTAG AATAATTAAT AGAGACATCT
17941 GGTCTCATGT TTCTACAGTT GCTCATGCCT TGATAGTAGA TCTCCTTGCT GCTGGCTCAG
18001 AAGGGTAAAA GAGCAGAAAT GATGGGGCTT CTCTCATTCT ATGAGGAAAT AGACCTATGT
18061 AGAGGAGGCT ACCTGTGGTA AAACCTTATC CTCATCACTT AAAATTCTAG GCTTATTCTC
18121 TGACCATATC AAGTTTTCAA ATGGTAAAAG AATTGGATTC AAGAGAAATA TGAATAAACT
18181 TTTGTTTTCA CTTTTCTCCC TCCTCTCCCC CCATTCTCCC TTCCTTTATT TTCTTGTCCT
18241 TAGTTTTCTT TTCACTTTTT TGTCTACTAT TATTTGCCCA AACTCAACTG TAGGCTAGAA
18301 CAAAAAAAAA TTGAAAATTA AAATGTGCCC CTTTTGTTGT TAGACTTGCT TAAACAATTG
18361 GGGTAATGAA CCTTGGACAC TAGATTTTAA AACACACACA TTTGAGCTTC AGTGCACTGA
18421 AATAAATATA TTTTTAACAA TTAAAAAATA AAATTGCATG TTTAAAAAAT CTGCAGAGAA
18481 CAATACACGT TGTGAGATCT TGAATGGAAG GAAAACTGCT AGCCTCAAGA GTGGATCAAA
18541 GATGCTCAGC AGGCAACAGA GTAAGAGCAT GTTGGAGGGT TTAGAGAGTG TGCTCAGGGT
18601 TCTAGGCTCT AAAAATCAGA CAGTCCCCAC GGCCTGGCCT TCGTCGCTGT ATCTTCTTTA
18661 TGAAAAACAC TAAGTCTTTT TCCTCACTGG ATAAATTTTT ATCCTTCAAG TTTAGATCAA
18721 ATGGAACTTT AGGACACTGA CTAGGTTACA TTCATCTTTT AAGAGCGTAC AGACATTCAA
18781 GGGCTAGAGG ATGTGGGTTT ACTGCACAGG CTCATTATCC AACAGCTGTG CTACCTGGGA
18841 AACTTAACCT CTCTGTGCCT TAATTTCCTC ATCTATAACG CAGGGAGAAT GACAGTAGGT
18901 ATCTCATAAG GTTGTTGGAA CAACTAAATG CATTGGTATC TATTGTGTAA AGTGCTTAAA
18961 ACACTGCCTG GCACAGAGCA AACATCCAGT GAACTTTAGC CATCATCATT ATCATTGTTC
19021 TCAGAGTCAA ATACAATATC TCATATCTGA TAAATTACAG AAGTGAATCA ATCACTCTCT
19081 CTCTTTTCTC CAGGGGAGA CAACAGCTTT TAGACATATC TTTTCCAACA GTCGTCACTG
19141 CTGGACACTG TTTCATCTTG CAAATAAACC AATGAAAATG AGTGATCCTA GAAGAAGATA
19201 AATGGAGGTA TTTTGAACAA TCAAAGAAGG ACAAATGAAC ACCTGGCTGA GAAAAATTAG
19261 CTCTTTTTTC TATGCATAAA ACTATTAAAA TATTCTTCAT AGAAATTTAT GACACAGGAA
```

```
19321 ACATAAAGAC AAAATTAAAA TAACTCCTAG TATCTCCTAT TCTTTTTATA TGTATATTAT
19381 ATATACTCAT ATTCATATAT ACATATATCT CACATCATGT ATCATATATA AAATAAATTT
19441 AGGTGTCATG ATATATATTT AGATAAATAT ACTTAGAAAC TTTTTTATGG ATGTATAATT
19501 TATGGATATA TTGATAATTA TGTATTTGTT ATTGACTACT TCAATTGATT CCCATTTTTA
19561 TGCATTATAT TATAGATTAT ATAGCTCACA CATCTTTGTA CATAAATCTT TGTTCAAATA
19621 TTATTTCCTA AGGATAGACT TCATGAAGTG GAAATACTAA ATCAAAGTG AAAAACATTT
19681 TCTAAGGTTC TTAACATATA CATTGCCAAA TTGCTATTCA GGATCATACC AATTTATAAT
19741 CCCAAAATAA TATGGAAATT CCTGTTTTAT AGCACTCATA TTTACAATAA ATTTTAAAAA
19801 TCACTGTTAA CCTAATAGTC CTTCAAAAGA AAAAAAAATT GAAATTACAT TATTTTAATG
19861 ACTCTATTAG TGAGGGTCAT TCTTCCCATG TTTCTTGTTA GCCATGACCC TATAAGAAAT
19921 AAACTGCACT GCAAAATGAT AAACATGACA TCAATCATTA CATGGGAAGG CACTATATAA
19981 AGAATAATAC CTTAGGTTAA GGCCACATAA ATATTTATCA GGTGCCTTTT CTGCGGAGGA
20041 CTCTGAAGGG ATACTAAACT GCATTTAGCT GCATGCAACT GAAACTACTT TTACCTACAT
20101 TGTCTCTTAT AAACATTATA ACTACTCTTT GAGAAAGTGT TTACTATGGA CTGAATTGTC
20161 TCCCCATCCC CCCAAATTCA TATATTGAAG CCATAAACCC CAATATGACT CTATTCCTAG
20221 ACAGGACTTA TAAGAGGTAA TTAAGGTTAA ATGAGGTCAT TAGGATGGGT TCCTAACTGG
20281 ATAGGATTGG TGGCCTTATA AGAAGAGGAA GATTCTGCAC TTGGTCTTCC AAATTAAATA
20341 ATTTATTTAA AAGAAAAAAA AAAAAGAGGA AGAGAGGGAG CTCTGCACAT ATACTGAGGA
20401 AAGGCTATGT GAGCTCTCAC AGTGAGAAGG TAGCACTCTA CAAGCCAGCA AGAGAGCCCT
20461 CAACAGAATC CAGCCATGCT ATACCCTGCT CTGAGACTTC CAGCCTCCAG AACTGTGATA
20521 AAATTTTGTT GTTTAAACCA CACAATCTAT GGTATTTTTT TATGGCAGCC CAAGCCAACA
20581 AAGACAGCAT CATTGCTGTC ACTTACAGAC AAGAAAACTA AGACTAGGAG AGAGAAAAGT
20641 TAAACTTGTC CAAGGTCACA AAAGCCAGAA ACAAGTGAGG TGAGAAGTTG ACCTTGTTCT
20701 CCTCAATCCA AGGCCAGGAC TCCTCCACTC CACATGTAGA TAGCCACCTC ACAGTCAACA
20761 GCCAAATGTC CACACCCCAG AGTCAGCATT AGACCAAGAT GTCTTACCAG GAGACAAATG
20821 CCTCATCTTG AATAAATATG ATCTAACAAC TTACCCATGT AAAACATTGA ATCTCATGAG
20881 AAACAAAAAT GCAAAGTATG TAGAAAACTA TGTTTACCAC TTAACTGACA GTGATAAAAA
20941 GCTTAATGAT ATCCTTATAG TCTTGGAGGG GTTTGTATAT GTGGTGAAAC AGGTGCTCAC
21001 GCACTGCTGA TAGACTGTAA ATTGGTCCTA GAGAGAAAAA TAAATAAACT GGAAGGAGAT
21061 ATGCTGTATG TTTACTTTTT TTATGGAAAC ATATGATATA CCTGGAAATT CGATTGACCA
21121 TGCATCTATT TCTTCAATGG GTATGCACAG TTGAGCTGTT CCCATGCACC AGGCACTGTA
21181 ATGGGACAAC TGCACATGAC AGTCAAAAAT CTCAGTCTCA TGAAGTCGAC ATGCTCATGG
21241 AGAGGTGCTA CCCACTAAAC TAATATTTGT ATATCAATTA TGGATACATT GGGCCACATT
21301 TACAGAAATT CACTTACAGT GGGTTACCAG AAGGGATTTT TTTTCTTGAT TGGCAAGAAG
21361 GCTAGGCTGT TTTGTTGGGG GCTGGCAGGA GCTGTCTAGG CTGCCCAAGT ATGCAGGTCT
21421 CTTCTATCAT CCTGTGTTAA CCATCTTCCA TGTATCTTTC AACCTCATGG TCATCTGCAG
21481 CATGTCTAGG GGTCATATCT ATGTTCCATG CAGGAAAAAA GGGTAAAGGG AAAGGGAAGT
21541 AGGCATGTAC CATTTTAATG CACACCTTGG TTTTCAGAAA ATTAAGAAG AAAGACTTTC
21601 TGCTTTTCTC TGACTATTCT GTATTCTGGA TTACAACGCA ACAGAAACGT CACCTTAAAT
21661 TCTAATGTTT TTCTCTCCTT GCTTTCAAAA ACTGACTCAT TAACCTCCAC GTGGCTTGGA
21721 AAAATTATTT CAGTCATCCA GTAATGAGCT GTTCATAGAA ATGTTTTGGA CATCAAGTCT
21781 GTGTTGTTAG CATTATACAT GTTAAGCATT GAATAAAAAA CAACATGATG TGGGTAAATT
21841 TCTTTACTTA CATATAAGTA CTTATATACT TATAGCTGAA AAGAGAGGTT GAAATGTCAG
21901 GTGGAACAGA AATAAGATTA CCTAGATGTT TCTCCTATGG GTGATTTTCA GCTATGCTGA
21961 TCTTTCTTCT GGGTCAGGTA CTCCCAGAAC TTCCTAATTA AATGGTGGCC CTGATCTTAG
22021 TTCCTCTCTC CTCTTAGACA TTTTCCAGGA CTACAGAAGA TGTGCAGTTT ATAAATGAGT
22081 AGCAGAAACC TACTGAACAA ATTATTCAGG CTCATCTGAA CAGAGAGGAC ACCTTCTCTG
22141 CTATACTCTC TCAGTGATTT CCCTGCCTTG GGTCAATTA TTGTCTTGGA CATTGATTTA
22201 AGCACATAAT AATTGTTGTC ATTGCTTATG TTTGGATTTC ATCTCCCAAA ATAGATGGTA
22261 AATTCTTTAG TTTAGAGACC AAGTAATACT TAAAAAAAAA TTTTGTGTGT GTGTGTGTGT
22321 TTTTCTGTG TCTCTCAGCC CTGTAATAGC ATCGTACTTA CACTTGTTAG ATTTTTAGAG
22381 ACAACTTTTA CAAAACATGG AATTATCTAC ATACCCTTTC TACAAAACAG ACAAATTAAA
22441 TACTCAGTAG TTGAACCAAA AAAAGCAGTT CAAATAAAAT ACTTGAAAAT GAAGAAATCA
22501 TTTGAACAGA GTTAAAGTTA ATCGTAAAAT AATGTCTGTA AAAATTATTG CCAATCAAAT
```

Figure 1 (Page 7 of 73)

```
22561 ATAAAGTTCA AAAATAGTGC TTGAAAAAGG AAGAATCATA TGAAAAGGGA CTACTCATTT
22621 TAAAAATGTT AGATATCAGG AAAAGCCAAG AAGTGAGTAT GGTAAGAGTG CTGTCAAGTG
22681 AAACCCTGCT AATCTCACTG AACATGTAAA AATCTGTAGA TGCCTTTATT TTATTCACTC
22741 ACACACATAT GTAGAAAGAG AAATATATGG TAAACATTAA AAAAACCAAA TTAGAATGTA
22801 AAATTAATAC TTTAAAAAAT GGGCTGTATA CTTTTCTTAT CACCGGAGAT AAGAATTTAT
22861 TATTTTTAAA ATAAAGTTAT TTTCTCTGTG ACTGTTTCCA TGACTTTGCT ACTTAGAAGT
22921 TAGAGATGCC AAAGTTTATC TAAGAAAATG TTTATGGAAA TATTATTTCA ATAATGAATG
22981 TTTAGAAGAC TGAATTTCCT GACTGGGCGC AGTGGCTCAT GCCTGTAATC CCAGCACTTT
23041 GAGAGGCTGA AGAAGGAGGA TCGCTTGAGT CCGGGAGTTC AAGAGCATCC TGGGCAACAC
23101 AGCGAGACCC TGCAGCAAAG TAAAAGAAA AAAGAATTGA AAAAGGAAGA CTGAATTTCC
23161 TTTGGGCAAG TCATGTGACA TTCCTGTGCC TCAGTTTCTT CATCTATAAA GTTAATTCCT
23221 ACATTTTTGG GGAAGGGAGA GAAAAACTTA GGATAGTGAC TGGCACAGAA GAAGCACTAT
23281 ATACTATATA TATGTGGATA TCATTTGTTT TTATGGTACC ATTTTAGCTA TCTAATGCAA
23341 AATATGAATC TTTTTTTTCT GGGTCTTAAA TTATGAATG TAAGAATTTT CTAAATTCTC
23401 TAATTCTGTG TTAGTTTTAA AGCAATGGAG TAACGTATCT GTCAACTTGT AAATATAAGG
23461 ATCAACCTGA TCCACAATTT GACCCCTAGC CACTAATATT TAATAGTACA ACACTCAGAA
23521 ATTATCAAAG GTCAGAGAAG CCAAACAAAT GTAAAACAT ACAGGTGCTC AGAAAGATGC
23581 ACCTGTAATC TCTCTAAGGA GAAATATTTT CCAAACTGAG TGACACGGTG CTTTAGTGAG
23641 TTGTGGAATC AATCTCATGA TTTCCAACCT AGTGTTCTTT TAAAAATGAA CTAGTCCACA
23701 GTAGAATATA CTAAAGTGCT GGTGCTTAAG ATAGTATTGT TTTCTGGAAA AAAAAAAAAA
23761 ATTTTTTTTT TTTGAGACAG GGTCTCGCTC TTGCCCAGGC TGAAGTGCAG TGGCACAATC
23821 ATGCTCACTG CAGCCTTGAC CTCCTGGGCC CAAGTGATTC TCCCACCTCA GCCTTTGAG
23881 TAACTGGGAC CACAGGTACG TGCCACCACA CCCGGGTAAT TTTTTAATTG TAGAGACAGG
23941 GTCTTGCTAT GTGCTTAGGC TGGCCTTGTG AACTCCTGGG CTCTAGTGAT CCACTAGCCT
24001 CAGCCTCCCA AATTTATGGG ATTATAGGCA TGAGCCACCC TACCTGGCCT GTTCCTGAA
24061 TTTTTTTTTC TTTCAGGTGT TTGTGCATAT GTGTGTGTGT ATGGGTATAA CAGAGAGACA
24121 GAGAGAAAGA AACTTTTCTA TCTCACTTTG CAATCAGAAG TTTGAAGTCT TATCTTTTGG
24181 CTTTTGTTTC AGAAATATTT CAAATGTAGA CTCTCTCCTT TACCACACTG TCCCCTTAGG
24241 CAAGGTCTTT GCCATTCTTC TGAGACTATT GCAACAGACT CCCAACTTCT GACTGTGGC
24301 CCTTCTCAAA AATGATTGTT TATGCAATAA ATCTAAACCC AAGACAACTA CAACAATACA
24361 ACAAATTCTC TGCTTAAAAA CTTCCAATGT CTGCCGGGCG CGGCGGCTCA CGCATGTATT
24421 CCCAGCACTT TGGAGGCAGA GGCGGGCAGA TCACTTGAGG TGGGGAGTTC GAGACTAGCC
24481 TGGCCAACAT GATGAAACCC CATCTCTACT AAAAATACAA AAAATTAGCC AGGCATGGTG
24541 GTGGGCGCCT ATAATCCCAG CTAATTGGGA GGCTGAGGCA GGAGAATTGC CTGAACCTGG
24601 GAGGTGGAGG TTGCACTGAG CCAAGATCAC ACCATTGCAC TCCAGCCTGG CAACAAGAG
24661 CAAAACTCTG TCTCAAACCA AACCAAAACA AAACTTCTAA TATCTACCAA ATGTTTCACA
24721 CAAGTATTTG GGGATCTTCA CAAATGGCCC TTATGGAGTT TTCCTTTGCT GAGACCCTAT
24781 GCTCTGGCCA CACTAAACTC ATTCAGCATC CCAGAAAGGC CTCAGCCTTT GTGAGCAAGC
24841 TCTTATCTCC AGGCCTCTCA CAAAGACCTG TTCCAGTAGA AGCTCAGGGG AGCACACTGG
24901 ACATTATTCC AACAACCCTT TCCCCACAGC TATGCAGCCA AATCTGCCAG CTCAGTTAAT
24961 TAATTAAGCA ATTCAGAGAT GAGGGTCTGC CCAGGCTGGA GTGCAGTAGC TGCGACCTCA
25021 AGCTCCTGGG CTCTAAGTGA TCCTCTTCAG TCTACCCAGA AGCTGGGACT GCAGGCATGT
25081 GCCACCACAC CCAGCTAATT TTTTTTTTTT TCAGTAGGGA CCAGGCCAAC CTAGTCTTGA
25141 ACTCCTGGCC TCCAGCCTTC CGAAGTGCTG TAATTACAGG CATGAATCAC TGCGCCCAGC
25201 CAACCCGCCC AGTCTTGTTA GACATGGGGT CTGTAGTTTC TAGTAGGTTC TTGAGTCTAG
25261 GGTTCCTACC TCATGTTTTA TAGTTAATTT AGGGGAGGGA CTGTGTCTGT TTATCTGGGG
25321 ATGTAGGGGT GGGCAGGGGG ATAGAGGGGA CTTCAATTAA TGAAACCAGA AGCAAAACTC
25381 AGTTGAGGAC ACCGGTCATG AGAGTGGCCT GATTATGGCC AATCTTACAT AATGTGTGAG
25441 ATCTTGATAT TACCCCATCC TTGAGAGTCC TCTATAAAGC TACAGGGACT TGGGAGCACC
25501 TTTAATTACA GACAACCCAT GTTCCTGTGG ATTATGATTT ATTAGATTGC ACATGCCTAA
25561 ATAAAGACAT CCTCTGCAGT CTTTTGACAA TTCTATAAGC ATCTTCTGAC TCCGCAATTA
25621 GACAGCTAAG AGATCTGTGT TACTTCCCTC ACATATATAA ATAATTTTAA ATAAAAATCA
25681 TGGCGTGAAT AATTTCTTTC CTCTACCGAT TTGAAGCTAT CCATTTGGAA GACCACTCTG
25741 AAGAGATGAA ATAAGTCTTC TGCCAAAGAT TACTTATTAA TTTACAAGGA AAAGGGGAAG
```

Figure 1 (Page 8 of 73)

```
25801 TTTTGTTCCT CTCCGTGAAT TTGATTGAAA ATCGAGGGCT TTCTCGAATA GTTTTGGCAT
25861 CCAGGGTCAT TTTTCATTAA AAAGAGAAAA GTCATGTCAA ATATGAATTT CCGCAGATTA
25921 TTCAGCACTA GACCCTGGGA GATTCTGTAA AGAGGGGTTT TGTTATACTC AACTTTTCCG
25981 GGTAAAACAA ACACAAATAC TCCTCCTCCA AGGGGCGGGG GCGGTGCCTA GGTGATGCAC
26041 CAATCACAGC GCGCCCTACC CTATATAAGG CCCCGAGGCC GCCCGGGTGT TCATGCTTT
26101 TCGCTGGTTA TTACATCTTG CGTTTCTCTG TTGTTATGTC TGAAACCGTG CCTGCAGCTT
26161 CTGCCAGTGC TGGTGTAGCC GCTATGGAGA AACTTCCAAC CAAGAAGCGA GGGAGGAAGC
26221 CGGCTGGCTT GATAAGTGCA AGTCGCAAAG TGCCGAACCT CTCTGTGTCC AAGTTGATCA
26281 CCGAGGCCCT TTCAGTGTCA CAGGAACGAG TAGGTATGTC TTTGGTTGCG CTCAAGAAGG
26341 CATTGGCCGC TGCTGGCTAC GACGTAGAGA AGAATAACAG CCGCATCAAA CTGTCCCTCA
26401 AGAGCTTAGT GAACAAGGGA ATCCTGGTGC AAACCAGGGG TACTGGTGCT TCCGGTTCCT
26461 TTAAGCTTAG TAAGAAGGTG ATTCCTAAAT CTACCAGAAG CAAGGCTAAA AAGTCAGTTT
26521 CTGCCAAGAC CAAGAAGCTG GTTTATCCA GGGACTCCAA GTCACCAAAG ACTGCTAAAA
26581 CCAATAAGAG AGCCAAGAAG CCGAGAGCGA CAACTCCTAA AACTGTTAGG AGCGGGAGAA
26641 AGGCTAAAGG AGCCAAGGGT AAGCAACAGC AGAAGAGCCC AGTGAAGGCA AGGGCTTCGA
26701 AGTCAAAATT GACCCAACAT CATGAAGTTA ATGTTAGAAA GGCCACATCT AAGAAGTAAA
26761 GAGCTTTCCG GGAGGCCAAT TTGAAAGAA CCCAAAGGCT CTTTAAGAG CCACCCACAT
26821 TATTTAAGA TGGCGTAACA CTGAAACAA GTTTCTGTGA CAGTTATCTA TAGGTTTAAG
26881 TTGTGATGCA GCTGAGTTGA AAAGGCTTGA GATTGGAGAA TTAATTCAGG CCAGGCTTCA
26941 AGACCATCCT GGGCAACATA GCCAGACTAC CATCTATACC AGGGGTCCTC ATTTCCCCGG
27001 CCACCGACCG GTAACCGGTC CCTGTCCATG GCACGTTATG AATTGAGCCG CACAGCTGAG
27061 GGGTGAGCGA ACATTAACCA ACTGAGCTCC ACCGCCTGTC AGGTTAGCTG CAGCATTAGA
27121 TAGATTCTCA TAAGCTCAAA CTGTATTGTG AATGGCACAT GCAAGGGATC TAGGTTTCAG
27181 GCTCCTTGTG ACAATCTAAT GCCTGATGAT CTGAGGTTGG AGCAGTTTTA GTCCGGAAAT
27241 CATTGCTCCC AGCCCCTGCA CCCCCTGGTC CGTGGTATAA TTGTCTTACA CAAAACGGTC
27301 TCTTGTGTCA AAAAGGTTGG AGACTACTGG TTTTACAAAA AAGTAAATTA GTCAAGCATG
27361 GTTGGCACGC TCCCTTAGTC CCTGCACCCA GGCGTTTAAG GATACAGTGA GCTATGATGG
27421 TGCTACCTCA CTCCAGCCTG GGTGACAGCG AGTCAGACGT TGTCTCAAAA CTTAAAAAAA
27481 AAAAAAGTTA AACAGAAAA AGGGCTTCTT GTCAGAGACT GCCGTATATC TAGAGGTCCA
27541 GGAACTAAAA AGTCTGATGT CCAATCCTGA AAAGCTCGAT GGTGCACTAG AGGAGGCTTT
27601 TACATGTAAG AGCATCTAAG TTCTGGAAAT GCCAGTGTCA GGGAAGGGAA GTGGAGAGCA
27661 ATTTGGCATC CAAACATAAC TTGCTGATAC TTTTTTTTTT TTTAACACAA GTACTACATT
27721 CTAGTCTTTC TGTGGTGTCA TTGTAACTAT TGTTTCTTAA TATGCTATCC ACTGACTTCA
27781 AGGGATCAAT AAATAGGAAT CAAGGTGTCC CAGAATATGG ATTAGGGGAG TTTTTTTGTT
27841 GTTGTTGTTG TTGTTGTTTT TCATCTATTC ATTATCCTGT AGCTGAAATT TAGAATTTTC
27901 TTCCATTGTG TGTGACTGAT AGAAATAACA AATTTGTAGG TTATAGTTGT TGCAAGAATC
27961 TGGAAATCGT GCTTGCTTAT TTCCGAAGTA CTATTAGGTA TATCAACAAA AACACACATA
28021 TTACGGTCAA GTGGTTTGAT AATTATTTTA ATATTATTGG TCTAATACAA TTGTAACCCT
28081 ATGAATTACT TTAAGTATCT TATTTATGAA AAGAATCTGT AAGTTTCATC AGACTACCAG
28141 AGCATACCGA AGACTGAAAA ATTTTAAGAA TCCAAACCTT AATGGAAATG TTGGAGGCTG
28201 CCCAATTAGG TTCTGAATTC CACCTTCCTG AATCACAAAC TTGTTTTAAC TCTCAGTCTG
28261 AGGTAAACTA CGTTTCTCTT TAAACAGACA TAGTTTAATT TTCCTTTGAT TTTTGATTTA
28321 GTATTCTTAC TGATCATCAT AAATAACCAA TGCTAATGTT AGTCTACTTT GGACCATGGT
28381 ATTTCGAGAA ACTTTGAACA AAGTCCCCTG CAAAACTATG CATTGCATTA TTTCACATAC
28441 ATTTATGTTT TCCAGACGGT TCAATAGTAC CTCACTTTTC TGAACTTATT TGTATAGTTT
28501 GGCATCTTTT TAAAAATTGT GTCCTATAAT GAAAGGTTGT AAACATTATG TTTTAAATTT
28561 GTATAGATAA AATCAACCAC AGACCTTTCC TTGCTTGGAT GTAATTGCCA TTGTTTCCCA
28621 ATGAGTTCGG AATTACTAGG ATTGTGCAAA AATATGCCTC ACTTGCCTGA CATAGCAGAG
28681 AGCCATTTTG CCTAAATGCT GTGCCCAGCA ATGGACTGTC ACCAGATTCT CATCACATAC
28741 AGTGAGGATG AACAACTAGC CTCTCCAGC AGCTGGCCGG TCTCTCAATA ATATGGGACT
28801 CCCTCAAGAT GGCTTCCTGC ACCTTTGCTC CTCTAGCCTT GTATGTATAC AAGGCTAGCA
28861 TGCCTGGCAT ACATAAGGTT AAAAACAAAA TCAATAAGTT ATGGTTCTTC CTCCAGTTCT
28921 GGGGATTATT AGACCACTTT TTTGTTTTGT TTTGTTTTGG ATGGAGCCTC GCTCTGTCAC
28981 CCAGGCTAGA GTGCAGTGGC ACAATCTCGG TTCACTGCAA CCTCTGCCTC CTGGGTTCAA
```

Figure 1 (Page 9 of 73)

```
29041 GCAGTTCTCT GGCTCAGCCT CCCACGTAGC TGGGATTACA GGTGCCCGCC ACCACGCCCG
29101 GCTAATTTTT GTATTTTTAG TAGACGGGGT TTCACCATCT TGGCCAGGCT GGTCTTGAAC
29161 GCCAGACCTC GTGATCCACC CACCTTGGCC TACCAAACTG CTGGGAATAC AGGCGTGAGC
29221 CACCGCGCCC GGACTTAGAC CACTTTGTTT TGGCCAATAG GACAACAGCC ATAGAACCCT
29281 CCGCAAATGA GAGCTTGTCC CTAAAGATGC TTTATTTACA TAGCTGTGTG CCGCATGAGC
29341 CAAAAGGTGA TAACCTTTGT TCAACACGCG CCTCCAGCCC TTCGGTTAAG TCCAAAGTAC
29401 CATTCTTAGA ATGCTCTAAA ATACATAATT TTTTTTTTTT TTTTTTTTTT TTTTTTTGAG
29461 GAGTCTCTCT CTGTCTCCCA GGCTGGAGGG GAGTGGCGCG ATCTCGGCTC ACTGCAATCT
29521 CTGCTTCCGG GCTAGCTGGG CCTACAGGTG CAGACCACCA CGCCCGGCTA AGTTTTGTAT
29581 TTTTTTTGGT AGAGGGGGTT TCACCATTTT GGCCAGGCTG GTCTCGGATT CTTGATCTCA
29641 AGTGATACAC TAGCTTTGGC CTCCCAAAGT GCTGGGATTA CAGTCGTGAG CCACTGCGCC
29701 CAGCAAAATG CTTTTTGTGG AGCCAATCAC TTTATTAGCG CTTACCTCTC TATGCCTACT
29761 TTATGCTTTG AAATTTTGTC ACAGTGTGGC CGGTCATGGC AAACACAATT CATTCTTATG
29821 CAGGATGTCA CGGTTATTTC TGTCATCCAA ACTCATTCTC GCAACGCATT TCAGCTCTTT
29881 AAACGACTTT GTGAGCGGCC CTGAAAAGGG CCTTTGGGTT TTTTGTTTT TGTTTTTTGA
29941 AGTTCTCAGG AGACCGCGTA TTCTTAGATT CAGCCGCCGA AGCCATACAG AGTGCGCCCC
30001 TGACGTTTTA GGGCATATAC TACATCCATG GCTGTGACAG TTTTGCGCTT GGCGTGCTCC
30061 GTATAGGTGA CGGCGTCTCG AATAACGTTC TCTAAGAAAA CCTTAAGCAC ACCTCGAGTC
30121 TCCTCATAGA TAAGACCGGA AATGCGCTTG ACGCCACCGC GCCGAGCCAA ACGGCGAATA
30181 GCCGGTTTTG TAATGCCCTG GATGTTATCC CGGAGCACCT TACGATGGCG CTTAGCACCA
30241 CCCTTCCCCA AGCCTTTTCC GCCTTTGCCG CGACCAGACA TGATTCCTAT CGCAGTGGAA
30301 GGTATGAACT GAAACAGTTC CTTAAATACA AACTTGGCGG ACCTGATTGA AAACAACATG
30361 AGTTGGCGCG GTTTTTTTTT TTTTTCAAAT TTGGTCACCA AGTGGGTGGA GCAAGAAAAA
30421 CTGTTTCATT ATGGTTCATT GTTTTGATTG GCCAGTGACA GCTTGCTCTT TGTGGGAGTG
30481 GAAGGGTGTT TGCAAGTTGA ATGCGCTGTA TTCCTGTCAG CTTAATGACG CTAAGCATAG
30541 CCCCATTCCA CATTTCTTTT TATTTCCACT TGCTAACTAA TAAATTACGG AATAGTTTAT
30601 TGGGGAACAT ACAAATAATG TTTAAAGGAG GTCAGATTTA TAGGTCAAGG GATTTACCCT
30661 CCCAATCATT TTAATATTTT TATTTAAACC AGGCATTTTG ATGGCCTTCT CTGTGCTGGA
30721 CAAGGTATAA GTTTGGCTAT GAAGTTTCAC TCCTAAAGAC CCTATGTTTT GGGAAGGCAA
30781 AAAGGTAGCC AAATAATTGC AAATTAAAAC CTCATAAGTG CAAACTTCTT CCTCGTCACT
30841 TTCCCTATCT CGATTCAAAT ATTTGTTGAA TGACTCATTT TTCTGCAAAA GTCTGAGAGA
30901 GACAGGGAAT ATAAACTTAA GTCTGGATAA TATGTTTTCC CGGGACGCTC TTCCTGGTCT
30961 GCTGTGCCTG TTTGCTGTGC CTGAAATTCC AAACACTCTT CCCTTCCCTC CGTTTTTAAT
31021 CCCCTTTCAA CTTGCTACAG CTTTAGAGAA AAGAACATTC GTTTTGTACA GTTGGGGATT
31081 AATTGAAGTG TAGGGCTAAT ACTTGATTAA GGTCATTACA AAATCTACAG GGTCTTCCTC
31141 TGGGAGGTTT TTGTGATAAG ATTATTGGTG TTAAAATAAG GCTAATCCCC TTGAAAAATA
31201 AATAGAATAG CAGAATTGGG TCTGAATGTG GTTTGAAGAA AGGGACTTCT CAATTCAAAA
31261 TTTTATTCTT AGCTTCCTGC GGGAGCTTTC CAGAATGCCC ATAAGATCCA CTTTTGTTTA
31321 AAAAACAAAA ACAACCCCAC CCACCACTCT CTGGTTAATA AATGAATTTC TATTGGGAAT
31381 ATTTAGAATG GGGCTGTGGC CTGTGAGAGA CATTATATAG TAACCTCAGA CTTGCTCACA
31441 TGAAGAGAAG AAATCCAGGA ATGGAGAAAA AAGACCCAGG AAAGGCCAGA ATGCTCTACA
31501 TGTCATATTG TTTGTATCAC TTCTGAAATA ATTGATTACA TTCTTCTGCC CCAAATTGAG
31561 TTCTTAGGTT CTTCCACTCA CTGTCCACAT GCCACAACAC AGACCTTATA ACTAGAGACT
31621 TAGCTAGGAA GAAATGTCAA ACATTACAGA GAAAAATGC AGAGTCTGAG ATCATAAGTA
31681 AAACTCTGAA ATCTCAACAT GCCTTTTAAT TCATGAAAAT AAAAAATATA GCAGCATATG
31741 CAATATGACA ATTCTCTGAA AACATACATC ATGTGAACTA CCCTGGAACA CATCTCGCCA
31801 AGTGCCATCT TCATTTTAAC CAGAGGTCTA GGATGCCTTT CCTTTATTTT GCCTATTATA
31861 TCATTTATAA AACCCCATTT TTATTTTGAT ATTTTATTTA CTTTCTATTT CCTGCTCCTA
31921 ATATCTCCTT TCTAAACTTT TCTCAATGAC AGTGACTCAA AAACAATGAA TGTCAGAACA
31981 AATATTTAAA GGATCTGTAC ATGTAGATAT ATATATTTAA AATGGATTCT TCCACTCTGC
32041 GAAGAATTCA GGCATACTCA ATCTTATGGT TAGGGAGAGA TTAGGCTCAC TCGCCTAATC
32101 TGTATGGCTT CTCGTTCGCT TTCCATTTCA CCTTCCTCTC ACCCATCAGA TCAAACTCAT
32161 TCATTGAACA AGAGACCTAA GCCCTTCAGA TTAAAACTCT GCAAACAAGT TGTGGTTGAG
32221 AGGATACATG AAGCATTCAA ACAAATAAAT CTATGATATT AATCAGAGGT TAATCTATGA
```

```
32281 TATTAATCAG AGGTTAATGC AGTGGCTCAC GGCTGTAATC CCAGCACTTC AGGAGGCTGA
32341 GTTGGGAGAA TCGCTTGAGC TCAGGAGTTC AAGACCATTT TGGGCAACAT AGCAAGTCTT
32401 CATCTCTACT TAAAAAAAAA TAACCAGAGG TGTTATGAAA ATATAAATTG TCCAGAACTA
32461 CCCTCCACAA ACTAACTCTC TCAGAATATT CGATATGAGG AATGAAATAT GGTGTGTGTG
32521 TGTGTGTGTG TGTGTGTATG TGTGTGTGTG TGTGTGTGTA TGCACCTATA TATGGCACCT
32581 ATATATTCAA CAAACAATTC TGATAATTGG CCAGGGTTGA GAATGACTAG CAGCCCAGCA
32641 TACACTATCA GTTTAAGTA TATAATTGCG CTTTAGTAAA ATGTAAAGAA ATCCCAGAGT
32701 AGAAATACTT TTAAGCTATA TTACAGGTGA GAAAATGCAT AAGTATAGTC TCACCCAACT
32761 TAGACTATGG GGGCTTTATA ATGTCACAAC AGTTGTTTCC AGGCATTTGG GGACATCACC
32821 ACTGGTCTTG GGCAAGAAAC TCCTCTAGCC AATGGCTGAT TTATCTCACT CCCATCTAAG
32881 GCTTCACTGC ATTTCTCTTT TTCAGCAACC TAACTTATTT AAAAATATCC ATTTTCTGAT
32941 TCATTTTTTT CTGAATTAAA CTGTCAGTAC CATTGGCACA CCTTTGGTTC CGTAGCATAC
33001 CTGTGTCTCT GCTGTGTTTT TTTTTTACCT CCACTCCTTA CTTTTCTAGA AAAAAATCTC
33061 TGCTTTTTCT TTTCAGTTTA AATTATTTCA CAAAAGTTTT TCTTGACTTG CACTTCCTAG
33121 GCTTGCTGTC CTTGTGTGGG CACGCTCCCA TAAACACTAT TAATACACTT CGATTTGTTA
33181 AAAATAAAGA TATCTGGACA GAAAATTTCT TTTCTTTTTT TAAGATTTTA AAATTTTTAA
33241 TGTTTATTTT TTTCCTAGAC TGGAGTACAG TGGCACCATG ATGGCTCATG GTAGCCTACA
33301 CTTCCCCGGG CTCAAGTGAT CCTCCCACCT CAGCCTCCCA AGTAGCTGGG ACTACAGGTG
33361 TGCACAACCA CACCTGACTA ATTTTGTTTA TTTGTTTGTT TTGTTTTTTG AGATGGAGTT
33421 TCGCTCTTGT TGCCCAGGCT GGAGTGCAAT GGCGGGATCT CGGCTCACCG CAACCTCTAC
33481 CTCCCAGGTT CAAGCAATTC TCCTGCCTCA GCCTCCCGAG TAGCTGGGAT TACAGGCATG
33541 CATCACCACG CCCAGCTAAT TTTGTATTTT TAGTAGAGAC GGGGTTTCTC CATGTTGAGG
33601 CTGGTCTGGA ACTCCTGACC TCAGGTGATC TGCCCGCCTC GGCCTCCCAA AGTGCTGGGA
33661 TTACAGGCGT GAGCCACCAC GCTCGGCCAC TAATTTGTA TATTTTGTAG AGATGGGCTT
33721 TCCCTGTGTT GTCCAGGCTG GTCTTGAATT CCTGGGCTTA AGTGATCTGC CCACCTTGTC
33781 CTCCCAAAAT GCTAGGATTA CTGGCGTGAG CCACCAGGTC TGGCTGGAAA GATAATTTCT
33841 AACATTATCC TCTCTTAAAC ATTTGTTTCA AAAATTTTAC AAACATGAGA GTAATTAAAT
33901 TTGATTTTCA AAATTCCCTT GAATACTTTC TTAATAGCAC ACAGAAAGCA CAAAGTATTT
33961 TACATTTGTT TTAATGATGA AATTGTGAAC CCAAACTTAC ACAAAGAAAA ACCCGTAACA
34021 TTATACCCAT ACTTAAAACA GATGCCCTCA TATACATAGT AAAACTCTTG GGGGCAGTAG
34081 TGAAGTTGGT TATTTACTGT TTTATGAAAG TGCCATTCAG CCGGGTGCAG TGGCTCATGA
34141 CTGTAATCCC AGCACTTTGG GAGGTCGAGG CAGGCTGATC ACGAGGTCAG GAGTTCAAGA
34201 CCAGCCTGAC CAAAATGATG AAACCCTGTC TCTACTAAAA ATACAAACAT TAGCTGGGCG
34261 TGGTGGTGTG TGCCTGTAGT CCCAGCTACT CAGGAGGCTG GGCAGGAGA ATCGCTTGAA
34321 CCTGGGAGGC GGAGATTGCA GTGAGCCGAG ATCGCACCAC CGCACTCCAG CCTGGGAGAC
34381 AGGGCGAGCT CCGTCTCGAA AAAAAAAAC AAAAAAGTGC CGTCATAGTG ACTCAGTTTT
34441 AAGGAATAAA TCAAGGATAT TTAACTCAAT AGACTACAGT TAGCTAACGT GACTTGCACT
34501 GAAAGTTATA CGATATTGG TACTTATTCC CCTGCCCCTG AAGTATGAAT TAAAGACTCC
34561 AAAATTCTTT TTAGAATCTT CAGAGTAAAA GCTAGAATTT GATTTTTTTA AATAATAAAA
34621 AAATACTTTG TATCTAAATC TGGTGTATAA AATAACTTGG TGGATGATGC TTCAAGGCTA
34681 TCCATCCCCA AATTTCTCCC TGAATGATAA AGAGAATAAA TGAATATGTC AATTCAAAAG
34741 TTAGAAATTT GGCCGGGCAC GGTGGCTCAC TCCTGATAAT CCTTTCGGAC GCTGAGGTGG
34801 GTGGATCGCA TGAGCTCCGG AGTTCAAGAC CAACCTGGGC AACATAGCCA GAACCCGTTT
34861 CAATAAATAA TAGAAAAAAA TGAGCCAGGC GTGGTGGTCC CAGCTACTCA GTAGGCTGAG
34921 GTGGGAGGAT CACTTGAGCT CAGGAGGTCG AGACTGCAGT GAGCCGTGAT CGCAGTACTG
34981 CACACCAGCC TTGGTGTCAG ACTGAGACCC TGTCTCAACA CAACAAAAC AAGTTAGAAA
35041 TTTGGCTGGG CGCGGTAGCT CACGCCTGTA ATCCCAGCAC TTTGGGAGGC CAAAAGGGC
35101 GGATCATTTG AGGTCAGGAG TTCGAGACCA GCCTGGCCAA CATGGTGAAA CTCCATCTCT
35161 ACTAAAAATA CAAAAAAAAT TAGCCGTGCA TGGTGGCATG CGCCTGTAGT CTCAGCCACT
35221 TGGGAGGCTG AGGCAGGAAA ATTGCTTGAA CCCAGGAGGC AGAGGTTGCA GTGAGCCGAG
35281 ATCATGCCAC TGCATTCCAG CCTGGGTGAT AGAGTGAGAC TCCATCTCGA GAAAAAAAAA
35341 AAAATTCTGT ATGAACTGAA CAAAATATCC TTAAATTTTA AAATACATCT GAAAGATATT
35401 TCAAAATATT TAGGAAAAAA ATTATAGGGA TCAGGCAAAT TCTGAGATTC CTTTTTCCCT
35461 GCAGCAAACA TTAGGAGTGC TGCTGTTCCT AAAAACATGG TAACTGTTGC CACACCGTAT
```

Figure 1 (Page 11 of 73)

```
35521 GTTTCCTTGG CTCAGACATA AGGTTGTGTA GTTGTTATTC CAGAATAGCT AGAATAAAAA
35581 TCCAGCACAT CATTTTCTTC AGCAAGTTAA CTAACCTCTC TGTGCCTTGG TTTCATAACA
35641 GCAACATAAG CATAACAGAA TAGCAGCAAT AGCTCCTACC TACCTCATAA GATTCTTTGG
35701 AGGAATTAAA TTAAGATTCA GAACACAGCC TAATATCTAG TAAGTAATAA TAATTGGCTA
35761 AAAAAATTTT CTTAAGATTA TATATATTCA TGGGGTACAA GTACAATTTT GCTACATTAA
35821 TATATTGCAT TGTGGTGAAA TCAGGGCCTT CAATCCATCC CGGAAAAAAA AAGTTTTTGA
35881 AAAGATTTCT GCCATGGAAA ACTTTTAATG TACAAATTCA TCCATCCAAG AAATAGAAAA
35941 TATATAAGTA TCAACTCCAA ATCCACCATA TCTATCTCTT CTACACCTTA AACAATTACT
36001 CAGAAATAGA ATGCTTGAGA TACCAGAATG CATGCATATC AAGTAATAAA TGCATGCAGG
36061 ATGTCAACGC ATCCTAGGCT TTCAAATAAA ATTGTCATAC AAAATACTTT AATATTGTAG
36121 TAACATTCTA CATGTTAGAG TGTAGAAGTT AATCGCTGAT GCAAAAAAGG AAAAGAACAC
36181 ATTATACCCA AAGCCTACAG AGAGAATCAC AATTACAAAT ATCAGCCTGC ATGTGAAAAT
36241 CTTTAATTTG AAAGTCAGAA ATATTTAAAT GATAGTCATT GTTAAATCAG ATTGTGGTTT
36301 GAAAAAAAGT TAGTTTAAAA CTGAGTTTAT GAAAAATTTG GGGATTTTAG AGACAGTGTT
36361 TTGTTTTTAA ATGTGTGTGA GTTTGTGAAG AATGTTTTAT AAAATACTGA CAGTATTATA
36421 AGATGACATT ATTATAATAC AACATAAGAA TTTTGGCCTG TACCTCTCAG CAGTCCTCAA
36481 TCACCTGCTG TACTTGACTC AATGATTATC AGAGTGGTTT GTTTTCCTTC TGTTGTGTTC
36541 CCAGTTCAGG CAGCTCAGCA ATGGCCTGTG ATTCCAGCAA TTCAAATAGC TGGTAAGTAG
36601 TTTCTTGTTT GTTTTCTCAA ATTTTCAGGG GCTTTTCTCT ACAAGTGATT TCCAGTGCAC
36661 GCCCCTCCAC CCATTCTTTA TTCCTTTACC TTCAGGAAAA CCCTCAGCGC TGCATCTCTG
36721 GTCACCGGAC CACCGTGGTA CATTTACCTA TGGCCACCAG GTGTCACCCT TCTCTTTACT
36781 ACCATGGTTT GTGAATGGTT TTGCCAGAGG TGAATAAGAA TTTAAAATGC AGGTCTTTGA
36841 TTTTTCAAAT GTAGTTGACC TTAAGAATTT ATGAATAAAG CCAGAAAAAT TAAGCTTAAA
36901 AAACACCGAA AGAAAATGAG GACTTAAAAT TTCTATTAAA AAAATTAACA GGCCACAGTT
36961 GCTGATGTTT AGTAAATGTG TTAGTGAAAT GTGTTACTGT GAAGACTGGG GTGTTTCTTG
37021 AAATCTCAGC CAGGTGAAA TAAAACCAAT ATAAACAAA TGCTTACCTA ATAAATTAAT
37081 TGTAACATAT TCCTTATGAG GTAGAAGAGT AAGTGAAGCC TTATAGCAGT CTGCTTTCAG
37141 TATAGTAAGA TATTAAGAGA GAAATAATTT GTCATATGCT TTCAGAATGG TTTGCTGGTA
37201 AAATAACCAA TGTCTTACAA CTTAGCGAC AATGTCCCTA GAGTGAAGAA ACACGATTAA
37261 TTCGGCTACC ACAGTTGAAT GAAAATATTC CGTAAGACAA AATGTAAAGA AATTAGAAGC
37321 AAAATAAATG TCTCCAAAAT GACAAAGCGA TTAAGTATAT ACACAAGATG AACAAGAACT
37381 TCAATAAAAT CATGCAGTAT ACAATACAAT ATACATTTAT TAAAGTATAT GCATTTTTAA
37441 TGCAACAATA ATACTAACAG GTAATAGACA AGTTGTTAAT AGTTTTCAC TGGCTAATTA
37501 AATAACAGCT TTAATTGTAT TCATTTTATA GCTTTTCTAC AATGAGCGTA AATCACATTT
37561 ACTTTTTTCT ACATAACTTT TCTAACCACA AAAAAGAAA ATGGTTTAAA AGAAGAGATG
37621 AGATATCTTT GCTAAAATTT AATGCCTAAA GAAGAAACTT CTGAGCTGTA TATGGTATCC
37681 TGAAGCACCT GCCCTTCAAG ACAGAATGCT TGTACCACAT TTATGCAGCC AAGTGCATGT
37741 AGTAACATAA AGTAAACACA TGCCATCTGG ATATATATAT TAAGACTCTT TTGACGGCTG
37801 GGCAGGGTGG CTCACACCTG TAATCTCAGC ACTTTGGGAG GCCGAGGCAG GCGGATCACG
37861 AGGTCAGGAG AGTTCGAGAC CAGCCTGGCC AACATGGTGA AACCCTGTCT CTACTAAAAA
37921 TACAAAAATT AGCCGGGCAT GGTGGTGCAC GCCTGTAATC CCAGCTACTT GGGAGGCTGA
37981 GACAGGAGAA TCGCTTGAAC CTGGGAGGCA GAGGTTACAG TGAGCCGAGA TCATGCCATT
38041 GCACTCCAGC CTGGGCAATA GAGTCTCAAA AAAAAAAAAA AGACTCTTTT GAACATGGTG
38101 AACTGATTTC CCAGAATCTA GCAATTCCTG AATGTCCTGG TTAGATTTTT TTTTTAATGT
38161 GCACCGGAAC CCCAGTGGCT CCATGGAAGG ACCTGGGCAT CCTCTAAGCC ACTTGGTGGC
38221 TTCCATTATA CCATCTCAAA ATGAGAGAGC TTACTCCACT TCATTGAGGG AAATACCACC
38281 AGAGTTCTGA CTCCAGAGGC ACTGGCCTAG GGAGGACACC GTGTGTGAAG CCCAGCAGGG
38341 CCACTAGCTG TCCCCACCAA TTACAGTCCT TGCGTAGGGT CCAAAGAAAT GAATGCCAAA
38401 GAGAGCAACA GAGGAGCAAG GGAGTCACAT TCCAGGACCT TCCTTCAGGG ACTTTTAAAG
38461 GAAACATGAC AGCTGAGGAT CAGTTGGTTG TTTTCTGCTG TTCCCCTTCA TGTGATTCAA
38521 GCTCACTCAG AAGAAACACA ATGAGACAAG AGAAGAGCCA TCTCCTTCCT TCTCTATTTA
38581 TTCTAGGCAT CTAAACTACT GAATGTAGTG GTGTCTGAGA TGTATCAAAC GGTCAGATTG
38641 ACTGAGTTTG AAACCTGTTT CTATCACTGA CAAACTATGA GATACTCTAT ACTTCACTTT
38701 CTTTTTTTTT TCATTTTTTT ATTTTATTT TTATTTTTTT GAGATGGAGT CTCACTCTGT
```

```
38761 CACCTAGGCT GGAGTGCAGT GGCGCAAACT CGGCTCACTG CAAGCTCTGC CTCCTGGGTT
38821 CATGCCATTC TCCTGCCTCA GCCTTCGAG  TAGCTGGGAC TACAGGCGTC TGCCACCACG
38881 CCCAGCTAAT TTTTTGTATT TTTATTAGAG ATGGGGTTTC ACCATGTTAG CCAGGATGGT
38941 CTCGATCTCC TGACCTCGTG ATCCACCCGC TTTGGCCTCC CAAAGTGCTG GGATTACAGG
39001 CGTGAGCCAC CGTGCCCGGC CTACTTCACT TTCTTCATTT AAAAAAGAAA TGGGGATAAT
39061 AGTACCTATC TCATAGAATT ATTGTAAGAA GTGCATGCAG TAATGCATGT AAGTAGGTGC
39121 TCAGAAGAGT CGGACACGAA GTAAGTGCTT TTATCATCCT TATCATAATT TTCATTATCA
39181 GAACAAGGAG AGACCAGGTA GAAAATTATT GTGATTCTTC AGGTCTGGAA TACTAGAGTA
39241 GCATCCCAAA TGAAGGCACC ATTAAACTTT GCAAATCTGT ATGACACCTT CATGCCAATT
39301 AGAAAAAACA CCTCTTCACA ACCCCTTTCA AGATATTTGC CTCCTACCTG CTAAAAACAC
39361 CCATCATACT ACCCACAGAT AGCCATGATG CTTTTTCTGG GACAGGTGCC TCTTCCATTC
39421 GTGCAGTGTA CAGCCTTCAT AGCTGTGCAA CTCACATCAC AATCAGATGG AAGAATCCCC
39481 AAGGCTTGGT GACAGATGAG TTACTGGGTA ACACAGAGAG AGGATTCAAA GGAAAAGTTG
39541 AACGGGTCCA GAAAATGCAT AGATACATGT GTAAAAATCT GGTAAGGTTA TGACTAGCCA
39601 CGTCCCAGGG TTCAAAGCTT TTCTCAGATG TTAAAATGAA TCATGTAAGT CCCCCAAATT
39661 TAAGGAGTCC TCTTCCAAAA ATAGGAAATG AAATGACATA GGTGTATGTC TCTGAGGTGA
39721 CGGAGGAAAT GAAGGAAGCC TCTAGATGCA GCTTGAGGTT CATGAGAGAC AGTTCCAGGG
39781 GAGAGGTCAC AGCTAGGGAT CACCGGCATG CAGGAACTCA GAAACCTAAA TGGGGAAATC
39841 TTTTTGAGGA AATGAACAGA GAAGGCTAAA ATCAAGGAGT TCGTCAGGCA ATTTCTATGT
39901 TTAGGTTCAA CTCTCTCCTG AAACATGAAG AGCTCATAAA TGCACTCCCT CTTTGAGTCT
39961 CTAGTTTTGT CTCCTTCCCA CAGTGAGTCT GCAGGCTGCG TGTCACTCAC GTTCAGCTAA
40021 GACGTAGTGC CCCATGGCTC CTCCTGTGGA GACAAGAGAC CCAGGAAAGA GGCATCACAA
40081 ACCTAGGCAC CATCTTGCCT CTTCTCTCTT CCTTATTTC  CTCATTCACC CATCTCAATT
40141 TAGACCTGGG CACTATTGGA TTTCAAGAAC CATTATCTCT CATCTGGAAA TGCTTATTGG
40201 CTTTCTAACT GGTCTCCTCA CCTCTCATCT AACTTCTTAA CAACACATTC ACCATATAAG
40261 GGAGATCGTG GTCCTCCTTT CTTAGGATCC TTCAATGACA CCCCAGTGAT CATAACCCAA
40321 TATCCCAAAA GACCCTTGGA CTCTGTATGA GCTGGCTTCT TTCTGATTCT CTTTTCCCTA
40381 CACCACAGAT GTTCAGGGGG TAGAAATGCA TAATTGGTGA GTGATAGCTA CGCAAACTCA
40441 GGGTTAAGGT ACAGTAATTA TTTCTAATCT CCCAGTATGC CTTATACTCT CCTACTTGGC
40501 ATGGTTGCTC CGTCTGTGTA GACCTCCCAT CATCTTCAAC CTCACCTAAT GGAATCCAGC
40561 TTCTCCTTCA AGATCCAGAA GGCTATCTTG ATCCCCAGCT GAATGTGATC ATTCTTTCCT
40621 TTGACACCCT AAGCATTTGC TTCCTGCCTG CTTTAGGACC TCATGGGGTC TTCTTTAACT
40681 ACATTTACTT GCTATCAATT TCATTCCCTA CCAGATTTGG GTTCTGAGAA TAGCCACAGT
40741 GACTTCTCAA CCTCAAAGCC CCTGTACTAC CTTAAACAGC TCTTGCAAAA TAGTAGGTGC
40801 TCTGAAGATG TTTGTTGAAT TAGAGACTTT CATTCTGGGG AGAACCATTA TTTTCTGTCT
40861 CCCAGGGAGC TGCTGGTGTC CCCAAAGAAT ATAAATGAGA AAAATGCTTC CATGGATGC
40921 CAGATCCCCT CTGCCCCTCT TCCCACTGTG CCCTGGGGCA GAGGTACTAA GAGACTTCCC
40981 CCTTGTTCCT ACTCACTTGA ACCCTGCCTC TTCCTTAATA TTATGAACAA AATTCCAATG
41041 AACAAGATGA CGACAAAAAC AGCAATTCCA CTGATGACTC CAATGACTAG GGTGCCAGAC
41101 GGTGAGGGCT CTAAAACAGA AAAAGCAAGT TAAAGCCTTT GATTGCCACC CTCAGCCCAC
41161 CCCCTAACAA AGAGCAGATC CTCATCTCAC TGCCATAATT ACCTCCTCAG GCACTCCTCT
41221 CAACCCCCAA TAGATTTTCT CAGCTCCTGG CTCTCATCAG TCACATACCC CAGATCACAA
41281 TGAGGGGCTG ATCCAGGCCT GGGTGCTCCA CCTGGCACGT ATATCTCTGC TCTTCCCCAG
41341 GGGGTACAGC CAAGGTTATC CAGCCCTGGT AGGTCCCATC CCCATTGGGC AATACGTCTT
41401 TAGGTTCGAA CTCCTTGGCA TCCATTGGCT GCTTATCCTT CAGCCACTTC ATGGTGATGT
41461 TCTGGGGGTA GTAGTTCAAG GCCCGACACC GTAGAGTGGT CACTGAAGAG GTCACATGAT
41521 GTGTCACCTT CACCAAAGGA GGCACTTGAC AGGAAAGAGG AAGGATGAGG AGAGGGATC
41581 TGTTTACCCT TGCCAGGAAG ACTGAACTT  TCACTTCCTT CTATAGGTTG GAGGAAGGAA
41641 ATACCCTTTT CAGAAAAAAA CAAGCTACAG GAGAGACACC ATTTTGTGTC CTAAGATTGG
41701 ACTCTAACAC AGTGTCACTT GGAGAGCAGT CAGATCAGCT TGTTCTCCTC ACATGTAAAT
41761 ATACATATCT GTTACCCATG TTCTTTGTTC TGATAGATAA AATTGCCCTT TATGTGCATT
41821 GAAAATGATT GAATACAGAT GGTCAGTTTC ACCTGGGTCA ACCTAGGAGG CATTGTTATA
41881 AGAAGCGGAC TTGTAAGATA GGTAGCTTCA GTGATTATTG CTATGTTCTA TGAAAGAAAC
41941 TTTTAACCTA AAGGATTCTT CTACTCTGAT AAGTGGCCTC ACTTGATATT TTGTCCTGGT
```

Figure 1 (Page 13 of 73)

```
42001 ATTCATATGA TAGCTGAGAT CTCTGAATTC TCTTTTTTTT TTTTTTTTTT TTTTTAAGAT
42061 GGAGTCTCAC TCTGCTGCCT AGGCTGGAGT GCAGTGGCGC GATCTTGGCT CAGTGCAACT
42121 TCCGCTTCCC AGGTTCAAGC GATGCTCCTG CCTCAGCCTT CCAATTAGCT GGGACTACAG
42181 GTGCGCATGA CTGTGACCAG CTAATTTTTG TATTTTTTTA GAGACGGGTT TCACCATGTT
42241 GGTCAGGCTG GTCTCAAACT CCTGACCTTG TGACCACCCG CCTCGGCCTC CCAAAGTGCT
42301 GGGATTACAG GGGTGAGCCA CCGTGCCCGG CCTTGACATT TCTGAATTTT TAACAGGTAT
42361 AAATATACAA AAGATTATTG GTTAAATAAA AAGCAAGGGC CATAGACACT TCCCTTTGAG
42421 CCATATGCAT GGAGAAAAGA AATTAAACCC ATGACTTGTG GCTGTCTCAT ACATCTCAAT
42481 TATAAGGTAG AGACTCTAGG ATTGAGAAAG TCCCTTCCCA GAATTTGGAG AGGCACACAG
42541 CCTCAGCCAC CTCTGAAACT CCAACCAGGG ATTCCGTGCC CTGCAACCTC CTCCACTCTG
42601 CCACTAGAGT ATAGGGGCAG AAGTGTGTTT CCACCATACC TTGTTGGTCC AAAACACCTC
42661 TCCCCAGCTC CAGCAACTGC TGCAGCTGTG CAGGGCAGTC CCTCTCCAGG TAGGCCCTGT
42721 TCTGCCTGGC CCGAATCTTG TGCCTTTCCC ACTCCAGCTT GGTGGGCCAG GCCCTGGGTT
42781 CTGCTGCTCT CCAATCCAGT GTGTCAGGGC AGAATTCAAG GTGGTCCTGC CCATCATACC
42841 CGTACTTCCA GTAGCCCTCG GTACTGTTGT CTTCTTGCAT TTCACAGCCC AGGATGACCT
42901 GCAGGGTGTG GGACTCTGGA AAAATCCCCA GCCTTGTTAA CTGCAACCAA AGGAATAGGT
42961 CCCTATTTCC ACCATCCCCA AGGACCAAAT GATCTCAGGA AGCAAATTCC TTCCCTCTTC
43021 CCTGCTCCCA CAAGACCTCA GACTTCCAGC TGTTTCCTTC AAGATGCATG AAAAGATGAA
43081 AAGCTCTGAC AACCTCAGGA AGGTGAGGCC CCCTCTCCAC ATACCCTTGC TGTGGTTGTG
43141 ATTTTCCATA ATAGTCCAGA AGTCAACAGT GAACATGTGA TCCCACCCTT TCAGACTCTG
43201 ACTCAGCTGC AGCCACATCT GGCTTGAAAT TCTACTGGAA ACCCATGGAG TTCGGGCTC
43261 CACACGGCGA CTCTCATGAT CATAGAACAC GAACAGCTGG TCATCACGT AGCCCAAAGC
43321 TTCAAACAAG GAAAGACCAA GGTCCTGCTC TGAGGCACCC ATGAAGAGGT AGTGCAGAGA
43381 GTGTGAACCT GGAGACAGAG CAACAGGCCT TAACCATGTG TAGTAGGAGG GGAGCAGGAT
43441 GTTGAGGCTC CACACACCTG CATCAACTCA TACCATCAGC TGTGTCTGGT CCTCATTTTG
43501 TGAAGGGTGA GTTGCAGTCC TGTCTTTCTT CCATATGACA GTCCTGGGTG CTCTTTCCTT
43561 GTGTGCTTTT CTCTGCCACA CGTGGCTGCC ACCCCCTCAC TGCCCCCAGA TCCTATTCCA
43621 ATACTCATGA TTAGACAGAC TCCACTAAAG CTGGTGGATT CTAGAAAATG TTAAGGTGTG
43681 TCTAGCCATG GTAGTTGAAC TCAGGAGTTG GTGCTCAGGG CAAATTAGAC CCAAATCCTG
43741 AGGAATAATT CCTTCAGTTT TTTTTTTTTT TTTTTTTTTT TTTTTGAGA CAGAGTCTCA
43801 CTCTATCACC CAGGCTGGAG TGCAGTGGCA CAATCTCAGC TCACTGCAAC CTGCACCTCC
43861 TGGGTTCAAG GGATTCTCCT ACCTAAGCCT CCTGAAAACC TGGGACTATA GGCGTGCGCC
43921 ACCACACCAG GCTAATTTTT GTATTTTTAG TAGACATGGG GTTTCACCAT GTTGGCCAAG
43981 CTTGTCTCAA ACTCCTGACC TCAAATGATC TACCTGCCTC AGCCACCAAA GTGCTGGGAT
44041 TACAGAAGTG AGCCACCGTG CCCAGCCTTG GTCCTGAATT CTTACACTGA ACTGCCTATG
44101 TGGCCTCACC ACTTGGAAGC CTGACTGGAA TCTCAAACTT AACATGTCCA AATGCAGATC
44161 CTTGATTTAC CCCAAACTGC TCTTTCCTCT GCCTTCACCA TCTCAGAAAT GGCATTGCCA
44221 ATTACCCCAC TGCTCAGGCC AATAAAATTA AAATAAAGAA CAAAGTCAAC TTTAACTCTT
44281 CTCTTTTTCA GGGGGTCAGG GGAGACAGGG TCTTGCTCTG TCACCTAGGC TGAAGTACAG
44341 TGGCACAGTC ATGGCTCACT GCAGCCTCAA CTTCCTGGGC TCAAGCAATA CCCTCCACCT
44401 CAGCCTCCCG AGTAGCTAGG ATCACAGGTG CATGCCACCA CACCCAGCTA ATTTTGTAT
44461 TTTTTGTAGA GAAGGGGTTT TGCTGTGTTG CCCAGGCTGG TCTTGAACTC CTGAGCTCAG
44521 GAATCTGCTC TCCTTGGCCT CCTCCTTGGC ATGAGCTACT ACACCCAGCC AATTCTTCTC
44581 TTTCTCTCAC ACAACATAGA ATCCTTCAGC AACTTCCTTC AGAATATATT CAGGAGACAA
44641 TGGTTTGTCA CTCCCTTTTC TGTTCCCACC CAGCCCACTC CACTACCTCT TGCCTGGACT
44701 GTGTAACAGC TTCCTGGCTG GGCTCCCTGC TTTTACTGTT GCTCCCTTCA TTCTGCTTTC
44761 CACATAGCAG CCAGAGCAAT CTTTTAAAAG CCTGTGACAG ATCACTGTTA CTCCTTGGCT
44821 AGAATTCACA CCACAGCCTA CAGGCGCCTG CACAACCTTG TTTGTGGCTC CTCTTCTGAG
44881 CCCATTACCT ACTTCTTGGC CTCTACTCCC CAGCACTACT TGTTTATTTT TTTCAACCCG
44941 AGCTTCTTAA CCAGGAGTTT GTCTACTAGG TGACATGTGG CAAAGTTTAG AGACATTTTT
45001 GGTTGTCAAG ACTGGGGGAG TGCTCCTAGC ACCTAGTGAG TAGGGAGGAC AGGATACTGC
45061 TAGACATCCT ACATGCAGAT GGTAGTCCCC CTTCCCACCC CACGCCGCC CCCCCCCCC
45121 ACACACACAC ACATGAGTAG TGCTGAGAAA ACCCGCTTTT TAATCCAACT TGCCAGGCCC
45181 ACTCAGTTTG CCTGGGAAAT ACTGCTCCCA GTCAATATCA TTCTTATTTC CTTCATGTCT
```

```
45241 CTGCTCAAGT GTCAGCCCCA GAGTGACTTG CCCTGACTTC TCTGCTTCTC ACAACACCCA
45301 TGATTTCCTG ATGTTGTATA TCTTTCTGCT CATTTGCTTA TTGTCATCTC TCCCACTAGA
45361 ATGCAAAATA TCAAAGGGTA AAGACTTGTT TCCCTGCTCT CTCCCTTGGG GCTTGAACAG
45421 TGCAACACAT GGCTGGGACT CATTTACACT TGTAAACAAT GAATATTTCT GCTCAACATG
45481 AAATTTTATT ATTCAACCTC TAATGCAGTG TGATGTTTAA GAATCATAGC TATGAAGTGG
45541 AGACATGAGC TCTGCCACCA AAGCCCAGTG TACCATTGAA TAAATTTGCC AGGAAGCAGG
45601 CCGTGCCATG CCTCATTCTT GTCATGTGTA AAATGTGGAT ACACGTAGTA CCAAAACTCA
45661 AAGTGCTGTG CTGAGGCCGG CGTGTGACCC ACAGAACACT GTGCTACACT ACAGGGCAAA
45721 ATCACTGTCA ACTAAGATTA GAAGCAGCTG TAGTACTTGA ATAACATCA GAAAACCAGA
45781 TTATTTATGT TCTTTGTAAC CTGAAAAGAG TTATATAATC TGAATTCCAG TTAACTTCTA
45841 GTAAAATAAA CGTATTATTA GCTCCTACCT CCCTATGCCT AGTGAAAATC AAATAAGATC
45901 AGATATGAAT GTAACTTAGA AGTGAGTGCA TTGCTTACAT GTTCATTATC AGTACTTTGT
45961 AGAGAGGCCT CTTAATTACA CAGCACATTG CAAATCAATA AAGCCTAGCC GAAAAGAGAA
46021 TTGTTCAGTT CAAACGTTCA AAACTAACAT ATACTTAATT TTCCAGGCAA AGAACAATT
46081 GCCAAGAGTG GGGAAAGGCC CGAGGTAGGC CTCTCTCAGG AGCCTCCCAC CCTAGAGACC
46141 TCCACCCCAG GTCTCACCAA AAGTGGGTGG AATGGTGAAG AATTCAGATC CCCAACGCCA
46201 CTCTTTCGCG CCCCCACCGC CCAACGCATT CGTTCTGAGG TGGAAACCCC GTGCGGATCC
46261 TGCTGTGGGT TTGCTCAGCC TTCTCGGCAA GCACTCAGGG AAGAACTTCC TGTTTGGAGA
46321 TGACTGGGGA AAAAACTGCA CAGCTGACAT TGGAAATAAA CCCGAGTTCC AGGTTCAAGG
46381 AGCCCCAGGC TTAGCTCAGC TCAAGTGAGG AACTACGAGA TTTATTTAAA AGCATTCTAG
46441 TTGGGGAAG GGAGTGGGCG GTTCCAAAAG TCACTCCGCA GAGCCGGGAC AGCCGGGGA
46501 GGGGCAGGT CCTGGGCGA GGGACCCCTA TCTGCAGTTC AGTGGTAGGC ACTCCCTCAC
46561 GGGGTCTGGA CGCAGAAAGT AGGGAGAGGG GCTTGCGGAT AGGGTTGAGC AGGTCCTCCA
46621 AAGTTAGCAA ACTCCCAAGC GCAAAGAAAA AGCTAGTTTC GATTTTTCCA CCCCCGCCGC
46681 GCCCCTAGTT CGCCCGCAGC CCTCGGACTC ACGCAGCAAG CGCCCCTGCA GGACCGCGGT
46741 CTGCAAAAGC ATCAGGAGGA GAAGCGCCGG CCTGGCTCGC GGGCCCATTT CCCCAGCTCT
46801 GGCCGCACGT CCCCGTTAAA TCTCCGCTTC TTTTGGGGGG CGGGGAAACG GGGATGGCTC
46861 CAGAAGTCAC CCTACAGCTA TTGCCTAGGC TCAGGAGATG CCCAGTAAAA CTTCCTGGTG
46921 AAAAGCAACA GGTCTTTCAG AACTTTAGTT CTCTCTCTCC TACAGCAGAA GGTACCTGCT
46981 TGTGAAACAC TAGGTGATCC AGTGTCCCCC TTGGTTTTTA AATCCTGAAG GGGTGTTGTT
47041 GATTGGGGAA AGTAGCTTCG CAATGTTCTG ATCTGAACTT TAGATATTTA AATATTTATG
47101 ATTTTCAAAA TTCAATCATA CATTTAAAAA TTTTATCTCA ACCTTAGACC AACTTATGTC
47161 TTATTTGACT TAGAAAATATA AAGCTTTTTC ATTTTGTTTT TTGATTCAAA TTAATTAAGT
47221 CATAACATTA ACCAATTAGA TCCTACTGAA ACACCTTCCA CAGCCTTCAT AATTGAATTA
47281 TCTGACAAGT GTTTCACAAA CTTTACAGTA TTGGGATTAT CTGGAGAATG ATTAAACATA
47341 TTGAGGCCTG CTCCTAACCC CAGACACACT GATTTAATGG GTAATTGTTA GGTAGTTAGA
47401 CATTAGCAGT TGGGAGGGGA TGACAGAAGA GAGCGGAAAG GCTGTCACTA AGACAGCCAC
47461 TGGCCCACCT AAATTCAGGC CCAAGACTAC CCTAATGCCA CCCTAAGGGA TGGAGTTTAT
47521 GATAAAGTCT GTGGCCAAAA TATCCTGGAG AAAGAGAAAG GAGGGTACAG GTGGAAATTC
47581 CCTAAGGTGG CACATGCCCA ACAACACAAA AGCCTGTCTT CAAGTTCACC CCAAGTTCAT
47641 CATGCCATCA TTATAATAGA ATTTACATAC AGTTTTGCCC CCCCATCCCT GGGAGGCTTT
47701 TCTTAACAAA TTATAGGTAA GACCATGCAC AGTTTAATTT TAGATTGTAT AGCTATACAC
47761 TTCAATCAAA TAACATCATC CTGTCACTCA GATACAGCCC AAACCTCAAC TCCTCCCCAC
47821 AAACCCCATA AAAGCACCTT GAGCTCTGTA AAGAAGTGCT GAGTTCACTT CGCAGAAATA
47881 AGCCCGCTGT CCCTCAGAGT GTATTATTGT GCTTCAATAA ACTTTGCTTT AAGCTTGCAT
47941 TTTGGTGTTA GTTTGTAGTT CTTTGCTCAC TATCACAAGA ACTGAGATTG CTGGTTCAGA
48001 GCTCCGGCTA TAATAATCTC CTCGGTTAAA GGATCCATCC CAATGCATAA TTCCCAGTAA
48061 CAGTATGGGA TGCCACCTGG GCAATGGGAT TTTAAAAGCT TTCCTTCTCC CTCAACGAAG
48121 TTTGGGAATT ATTGCCTTAG ACATTTCAAA CAATATTAAT AAATTTAATA CACCTGATTT
48181 GCTCCAAACC TTTACATATC TAGCAAATTC AACAGGCATT ATTTTTGTAA GCATGTATGC
48241 AAATTTTGGC AATTCAAGAA AATCAAACAG GATATCAGGG CCTCGACTGT AGGCAAACAG
48301 ATACAATAAC ATTGGAAACA TGTAGAATAT TGATGATGGG CACATTGGGG CTGATAGTAC
48361 TATTCCTTTT TTTCAATTTT TGGTAAGATA TAATTAGCAT ACCATATAAT TCATCTATGT
48421 AAAATGCAAA AATTGGCCCG GCTCAGTGGC TCACGCTTGT AATCCCAGCA CTTTGGGCGG
```

Figure 1 (Page 15 of 73)

```
48481  CCGAGGAAGG CAGATCACCT GAGATCAGGG GTTCGAGACC AGCCTGGCCA ACATGGTGAA
48541  ACCCCGTCTT TACTAAAAAT ACAAAAATTA GCCGGGCGTG ATAGCAGGCA ACTGTAATCC
48601  CAGCTACATT AGAGGCTGAG GCAGGAGAAT CGCTTGAACC CGGGAGGCGT AGGTTGCAGT
48661  GAGCTAAGAT CGTGCCATCA CACTCCAGCA TGGGAGACAA GAGCAAGACT TCATCTCAAA
48721  AAAAAAAAAT TAGCTGGGTG TGGTGGCATG CACCTGTAAT TCCAGCTACT CGGGAAGCTG
48781  AGACAGGAGA ATCGCTTGAA CCTGGGAGGC GGAGGTTGTG GTGAGCCGAG ATCATGCCAT
48841  TGCACTCCAG CCTGGGCAAC AAGAGCGAAA CTCCGTCTCA AAAATAAAAT AAATAAAATA
48901  AAATGCAAAA ATTAATGGAT TTTAGTATAT TTACAGAGAT GTGCAACCAT TACCAAAATT
48961  TTACATTTCT ATCTCCCCAA AAAGAAACCA TGTTCCCCTA ATTCAGTACC CTTAATTCAT
49021  CGCCTCCCAG ATTCCTCCAT TCTCCTCCTC CTCCCCTCCC AGCCCTAGAC AATCTTTAAT
49081  CTACTTTCTT TCTATTTGGA ACATTAGTA  TACATAGAGG CATATAATAT ATTGCTTTGC
49141  CGTGACTGGC TTCTTTCATT TAGCATAATG TTTTTATGTA TGTTTTTCAT GGACCAATAA
49201  TATCTATTAT AAGGACATAC CACAACATAT TTTATTTATT CATTCATCAG CCGATGGACA
49261  TTGGTTTGTT TCTACTTTAT GGCTATTGGG AATAGTGCTG TTATAAACAT TTATGTACAA
49321  GTTTTTTTGT AGACTTATGT TTTGATTTCT TTTGGTTATA TATCTAGAAG TGGGTTTGCT
49381  GGGTCATATG GTAACACTGT TTAACCTTTT GAGGAATTGC ACACATTCTTT TCCAAAGTAA
49441  GCATTTTATC CTCCTATCAG CAGTGTATGA GAGTTCTGAT TTCTCTCCAT CTTTGCCTGG
49501  GTTTTTGAAT CAGGGCCCCA GATAGAACAA AAATGTGGTT ATTCAGTTGT TCCACCATCA
49561  CTTGTTGAGA AGACTCTTTT TTCATTGAAG TGTTTTGGCA CCCTTATCAA AAATCAATCT
49621  ACCATAAATG TGAGAGTTTA TTTCTGGAGT CTCAATTTTA TCCCATTATG CTATAATCTA
49681  TAATCCTATC TTTTTTTTTT TTTGACAGAG CCTCACTCTA TTGCCCAGGT TGGAGTGCAG
49741  TGGCCCAATC CCGGCCACTG GCTCCTCCTC CCAGGTTCAA GCAATTCTCC TGCCTCAGCC
49801  TCCCAAGCAG CTGGGATTAC AGGTACCTGC CACCATGCCT GGTTAATTTT TGTATTTTA
49861  GTAGAGACGG GGTTTCACCA TGTTGGTCAG GCTGGTCTGG AACTCCTGAC CTCAGGTGAT
49921  CTGCCCACCT CAGCCTCCCA AAGTGCTGGG ATTACAGGCA TGAGCCACCA CACCCAGACT
49981  ATAATCCTAT CTTTATGTCA GGACTACACT GTCTTGATTA CTATAGCTTT TTAGTAAATT
50041  GAATTCAAGA AGTTTCTCAA CTTCAAATTT GATCTTTTTT TGGAAGACTA TATTAGCTAT
50101  TCTCAGTCTG CTGAATTTCC CTAGGAATTT TAGGATCTAT TATCAATGTC TATTCTATTT
50161  TTGTATATGT TTTAATATTT TCATAAGAAA CTTTTTTCAT TTAAACTTTT TTTTTTAAGA
50221  AAAATAGTGA AAATCAGAAC ACTGGGGGTC AGGCGCATTT AACAGGCAGA AGAAGAATAA
50281  AAACTTGTCA TATAAACAAA AAAGAAATGA CCAATCACAT TGTGGAAGCC ATGGAGTGGT
50341  TATAGGTGCC AAAGGCTGCA GAGAAATGGT GTCAGATATA CCTGAAAATT GTCCATTGTA
50401  TTTGGCCATT AAGAGACTTA GAAGACTTAA GCCATAGATT GCTCAGTGAG ACCCCGAGGG
50461  CAAATGGTCT GAAGGTGAAT AGATCATTTC ACCTTTAAGA GAGCAGGTAG GAAGCTATAA
50521  ATCCAAGATT AAAAAGTTGA CTGAACTGTT AAGGAAGAAA CTCTAATCTT GAGCCACCCT
50581  ATCCTGGCTC CACCTTCTGC TGCAAGCAAA CAGAAATGCT GAAATTCAAC ACTCACAAAG
50641  GCTGGTAAGC TGGAAATGAC AAAAATTACT CCTGGGAAAG TCAGATTTAG AATTAGGCCA
50701  TATTTGTTGG GGTTCAGATT TTCATGTACA CTTGGGAAAG GGTTTAGCTT ATAGGCACAT
50761  GCATGAAGGG AACTGGTATA GGGCTGTGTT CATAAGGTCA AGAGTTGAAG GCCAGGCATG
50821  GAGGCTCTTG CCTGTAATCC CAGCACTTTG GGAGGCCGAG GCAGGAGGAT GGCTTGAGCC
50881  CAGGAATTCA AGACCAGCCT GGGAACATA  GGGAGATGCT GTCTTCACAA AACAATTAAA
50941  AAATAAAATT AGTCAGGTGT GGTGGCACAC ACTTGTGGTC CCAGCCACTC AGGAGGTTGG
51001  GAAGATCACT TAAGCCTGGG ACATTGAGGC TGTAGTCAGC CATGATAGTG CTACTGCACA
51061  CCAGTCTAGG TGACAGAATG AGACCCTGTC TCCAAAAAAA GAGCTGTATC CACATCCCAG
51121  GAAAGTGGTT GAAGATCTAC TTTTCTCTGT AAACCTAATA AAGAATAGAG TGACAAATGT
51181  GTGTTGTGGA AAGAAATGGG GTGAGAGCTA CGTAGATGCA AAACAATACA TCCCCACATA
51241  CCACTTGTTA ATCATCCTTT TCCACCCACT TATGGGATGA ATTGCATCTC CCCAAAAGAT
51301  ACTCTGTCCT AACCCTCAGT AGCTGTGAAC CTGACCTTAT CTGGAATACG GTGAGTTCAC
51361  TGGTTAAGAA GAGATTATAG TGGAATAGGG TGAGTCCTCC AACCAATGAC TGGGGTCCTC
51421  ACAGACACAG AGGGATGATG GCCAGGTAGA GATGGAGGCA GAGATTGGAG TTATGCTGCC
51481  ACAAACCAAA CACAGGAAGC TGCTAGAAGT GGAAACAGGC AAGAAGAAT  CCTTCCCCAG
51541  AGGCTACAGA GGGATCTTGG CCCTGATAAT ACCTTGATCT CAACTGGCCT ACGTAACTGT
51601  GAGAGAATAA ATTTCTTTTG TTCTAAGCCA CCCAGTTGAT AGTACTTTGT TACGGCAGCC
51661  CTAAGGAACT TGATATACAT TTCTTTTACT GTCATAGAAG TTTTGAATCT TTTAAGTAGG
```

```
51721 TCTGTACCCT TCCTCCCAGT GTCAACACAT GGAATTCCTC TCCTTGTGCC TTGAAAAGTG
51781 AAAGGTGTTT GAACTGGTAA TGAAAGAAAT CTCAGCATGA GGCCAGATGC TGTACCTCAC
51841 ACCTGTAATC TCAGCACTTC GGGAGGATGA GGCGGGCAGA TCACTTGAGG TCAGGAGTTC
51901 TAGACTACTC TGGCCAACAT GGTGAAACCC CATCTCTACT AAAAACAAAA AATGTTATCC
51961 TAGCCGGGCA TGGTGCCTGT AGTCCCAGCT ACTCAGGAGG CTGAGGCAGG AGAATTGCTT
52021 GAACCCGGGA GGTGGAGGTT GCAGTGAACT GAGATCACGC CACTGCACTC TAGCCTTGGT
52081 GAGAGAGCAA GACTTGGTCT TAAAAAAGAG AAAAGAAAAA TGAAATTTCA GCATTATAGA
52141 ATAAAAATGT TTCCCCTTCC CCCCAAACTT TAAAAAAGCA GAAGTCTGCA TCATAAAATG
52201 GTCTTTGCCA ATGTTATTTT TATTATAACA AAGGAATCTT GCAAGGCTAC CAGATCTCAG
52261 CAATTGTCAC TATGTTCTGT AAAAATCACT TCCTAAAATG TCTGAATTGA CTGCTTGTCT
52321 CATTTATTTG TTTCTCGTGT CATACTGCAA TGGATATCTG TCTTGTTAGT ATAAATATTT
52381 GTGCATTTTG TTGTTGTTAA AACAGCTTTT TTGGCCTGTC TTCTTCCACC TATGAGGTAA
52441 TATAAAACTC ATGTTTAACA CTTATTTTTG TAGCAGGACA AGCTACAGAC AAAACCCCTC
52501 AGACACTGAG TTAAAGAAGG AAGGGCTTTA TTCAGCTGGG AGCTTTGGCA AGACTCACAT
52561 CTCCAAAAAC CGAGCTCCCT GAGTGAGCAA TTCCTGTCCC TTTTAAGGGC TTGCAACTCT
52621 AAGGGGGTCT GTGTGAGAGG GTCATGATCG ACTGAGCAAG TGGGGGTATG TGACTGGCAG
52681 CTGCATGCAC CAGTAATCAG AACAGAACAG GGATTTTCAC AGTGTTTTTC CACACAATGT
52741 CTGGAATCTA TAGATAACAT AACCGGTTAG GTCGGGGGTC AATCTTTAAC CAGACCCAGG
52801 GTGCAACACC AGGCTGTCTG CCTGTGGATT TCATTTCTGC CTTTTAGCTT TTACTTTTTC
52861 TTTCTTTGGA GGCAGAAATT GGGCATAAGA CAATATGAGG GGTGGTCGCC TCACTTATTC
52921 ACCCCCTTTG AGAATCTCAC TCATTAGTGG GAGTTCTCAC TTTTATTCTC ACTACCTATG
52981 TCTTCTTGAA AGACAGATTG ATAATGATTC ATATAGTACA CTTGTGCTGA AGCATTTGG
53041 TGAGCTAAGG TAGTGATGAA GCTTTTTATC ATTTGGAGAA GTACAGGTAG CAAACAAGGA
53101 AGCAGTAAGC AGGTTTCTAT TAATATTATA ACTCCTATTA TAAGAGTTTT AAATCTTCTT
53161 AGCACTCGGA ACCATTTTTC AAACATGGCC CCAGAAACAA ATCCATACCA CACCTACATG
53221 GGCACATGTG CCACTTTTGT CATATTTCTA ACTATGTCTT CAACTACTTG CCCTTAATCA
53281 TCTATGTGTA GACAGCAATT AGTAAGGTTA AATTTCCTAC AGACCCCTCC TTCAGTTGCT
53341 AGCAAGTAGT CGAGAGCCAA TCCATTTTGA TAGATAGCAT TTTGCATCTG AGTTTCTTGC
53401 CAGGCCACAG TAGTCAGGGC TCTGCTGGTC TTATTAGTAA TTATTTCTAA GACAGCTTGT
53461 AACCGTATGA TTCAGTTGAG CATGTAAATG GGGGTCCCAT ATCCCCACAA GCCGTCTTGT
53521 GCCCAAGTAG CAGGCCCATA ATATTGTATG ATTCTCTCAG GGGGCCATTC ATTATTTTTC
53581 CAATTTTCTA TAGCTATGCT TTTTTTTTTT TTTTTTTTTT TTTTTTTTTT TTTTTTGCGG
53641 GAAGCATATA CAGGGAAGCC CAGGAGTTTG CCTGTCTTTA TGGGCAGTAG GAAGAAAGAT
53701 GGTTTAGTAG TGTCAATAAC ACAACTACCT GCCCACTGGT CAGGTAATTT GGCATAAGCT
53761 GTATGCCCAC ATATCCAGTA TAATCCAGTG GGGGCTGTCC AGTCCCGGTG GGACTCTGGG
53821 TGGGTCCACA CAGTTTGCAA CTTTGGGAAT TTACTAAATA GATTTTTCTT AGTGTGGTTT
53881 GAACTCCACT AGGTGGCTGT TTTTATAGTA CTATTATACA GTTTTGCCC AAGGCAGCTG
53941 AGTCTTCCCA CAGGAAGGGT GAAGTCCTTC CCCACTTTTG CTATACAGTA TTGTCAATG
54001 ATTGAGGCTT TTAGGACCCA GAAGTTATCA GGGTGAGTCT TTTGAGCTGG GAATTTATCA
54061 GGAACTGGGT CTGTAGGTAC TAATTCTCGT GCTTCCCATG GCCATTGATC TCCCATTACA
54121 GTTCCTCCAC ATACATACAT AACATGAAGT GACATTGAGA GACTGGGCTA CATGCTCAGC
54181 TAATTGCAAA AACAAATTTC TTGTTTTCC TGGAATTTCT AGTACTGGCA CATTCAGTTC
54241 ATCATAAGAA GGTTTGAAAT ACTGGCTCAG GGGAGCATTT ATAAACTTCT CCTCAAACCA
54301 CCATATTTAC TCAAGGATCC AGTCCAGCCC CAACTATTTC TAAGGTTACA CGATCCCCTT
54361 TTTTCCAGTG AGAATCAAGG GGGTTGGTTA TTACTAGTTC TAAGGGGTTA CACTGACCAC
54421 TGGTACAGGA AGGGCCACTT TTCCCTTTCT GAAGGTGGAC AGGATTCTTT TTATTTTTA
54481 ACCAAGTTGC CTAAATGACA CAAGACCAGT ATCTACATTT ATTTCCACGC AGTCTTAATT
54541 CATGACAAGC GTACTTATTT TCTGCCATAT AGCCTCTTTC CTAATGAACA GAACCACATC
54601 CTATTTCTAA CTTATTACTA TTAATGACAG CACAGGCATC AAATTTCAAG GTGACTTGTT
54661 TGGGCATTCC TTTTTCTTCT GTTTTGGCTA ACACTTTACT CGTATCGTTT ATGAACCCCC
54721 ACCAGTCCTC AGTCCTCAAT CTTATTTCAA AAACTGTGGT CGTGGGAGGC TCAGATGGGT
54781 CATAACACAC ATCAGGTTGG TCATTTCTTG GGCTACCTAC CTTGTATAGA ATAGCATTAT
54841 ACAAACAAGT TATTTTTAGA GTCTTTGTAC ACTTATAATA ACCATAAAAT AATAAGACTG
54901 TAGCAACTTT TTGTCCTACC TCAGTGACTT GATGTATACA CTGGGAACAG CCCTCAGTCT
```

Figure 1 (Page 17 of 73)

```
54961  GAGGAAGGTT AGTTGAAGTC TTTACTGTGC AAGTCCAAAT TTTAAGGAAA ATGAGTCCCT
55021  TGATGAGTTT TCTCATGTTT CGGCCATGCA TGGACCAGTC AGCTTCCGGG TGTGACTGGA
55081  GCAGGGCTTG TTGTCTTCTT CAGTCACTTT GCAGGCGTTG GCGAAGCTGC CACGTACAGC
55141  TCACAGTCTA CTGATGTTCA AGGATGGTCT TGGAAGTTGG GCCCACTAGA ATTAACTGAG
55201  TCCAATACCT CTACTCAGTC ACTTTCAACT GGGCTTTCTG ATACCAGGAG CAAGGTGGCA
55261  GGTTTTAGGG TGTTGCAAAT TTCAATGGTT ATGCAGGGAT TTTCACATAG CAAACTTTGG
55321  TACTTGGTTA ATCTAGCATT TGTTAGCCAA TGATGTATTT ATTAAAGTCA CCACAGCATG
55381  GAGGGCCTTT AAGTTAGGT TTTGTCCAAG AGTTAGCTTA TCTGCCTCTT GTGCTAGCAG
55441  GGCTGTTGCT GCCAAGGCTC TTAAGCATGG AGGCCAACCC TTAGAAACTC CATCTAGTTG
55501  TTTGGAGGCC CAGCCTCGGC CAGGGCCCCA CAGTCTGGGT CAAAACTCCA ACCGCCATTT
55561  TTTCTCTTTC TGACACATAG AGTGTAAAGG GTTTTGTCAG GTCAGGTAGC CCCAGGGCTG
55621  GGGCCGACAT GAGTTTTTCT TTTAACTCAT GAAAAACTCA TTGCTGTTGG TTGTAATAGA
55681  TGTAGTTTAT CCAATCTACA TTTTTATTAA CTGTCACCCA CCAAATATT GACTCAAATC
55741  CTGCAGCTAT TTGATTTTGG GATTTAAATT GATCTGCTAT TCCCTGTGGG ACTCCAATTG
55801  CATCTAAATA GATGTGAGAG TTGAAAGACA CATAAGGGTC TTCTCTTGCT TTACGATGTC
55861  TTATTTTTCC TCCCTCTGGT TGATGAAATG CTAGGGTGAA AGGGATAGCC AATTGGACTA
55921  AAGTACAAGT GCCGCTCCAG TTATTTGGCA GAGTGCCCAG TAAAGGTCCA CCACAATACC
55981  ACCACACATC CGCTTGGGGA TGAACAAAGG CTGACTGATT GAGAAGCTCC TGAAAATTCT
56041  TAAGCTCACT GCATCCCTTC AGGTCTCCAA GGAATGCTAA GTTTCCTCCC TGTCATGAGA
56101  GACAAGAAGT GAACTTAGTT TTGGGAGATG GAAGCTGGAT GGCCCTCAGG GGTTGACCTG
56161  CAGGGTGCTG GACTTTGGGA TATAGCAGAG AGAGCTTGGC ACGACTTATT ACTCCAGGCT
56221  GTAGAATCCT GGAAAACAGT TACCATGCAG CCCATGCCTG GTCAACAGGA GGACCACCTT
56281  AGTGGAAAGG GGATAATCTG GCCCTCTGGC CTGCCATGTG CACAAGCATA ACAATTGGTT
56341  TTGTTTAATG TGTGGACAGA ATATTTGATC CATTCCAACT GGGCATTTGC ATCTTGGTAT
56401  CCTGCTTAAT TATCAAAGTT TGTTTTAAGT CTTTAACTTC TATGACCCTC TAGTAAAATG
56461  AATGTATGAT TTTAGGAAAT TACAAAAACC GGTTGGGCA GTCCATCCTT GCTCTTTAGT
56521  GGTCCACACA ACATTCGACC AACTATGGCA TAAAAGCTCT ACATCGGGGG CAAGACTCC
56581  TCGTTGACAC TGGGGTCTTT ATTGAAATCT CTCTGGAATA AATGGTCTCA GTTTACTAAG
56641  GCTCAGTCTG AGGAGAGTCA GGAGGGACAG AGGTACTTTT CTGAAGTACA GAGATGTCTT
56701  CGACTTGGCA AGTCCCCACA GGGTATAACA AGGCAAGCAT TAAATTCAAT AGTTTGAGGC
56761  AAAATTGACT TGGTTATGTT AATAACTAGA TGGTCAGAAA TAGAGTGAGG GAAGAAGAAA
56821  GAGTAATAGA ATAGATGAAG GAGTTAAATT TTTCTTAGCT TTAGTTTGGT AGGGTTTTCC
56881  CCTGGGACTA TGGCCCATGA CTCTGGAGGG GGTGGCACTT TCTTGACTCG GGTGTGATGA
56941  GTCCATCCCT TTTTCACCGT ATGAACAACA GTCTCGGTGG TTAGCAGCAC AAGGTAGGGT
57001  CCTTCCTAGG CTGGCTCAAG TTTTCCTTCT TTCCACCCTT TGATGAGAAC ATGATCTTCA
57061  GGCTGGTGCT GGTTTACAGA AAATTCTAGG GGTGGTACAT GTGCTAAAAG ACTTTTAGTT
57121  TTGAGGGAAA GGAAAGTGGA AGATAAACCA AGTATATAAC TTTTAAGAAG TTGACCTTTT
57181  GTTTTAAATG TGGGGACATC AGCAGTGGAC TTTATAGTCC TTGGTGCCTT CTTACTGAGA
57241  AATTTCCTTT AGCACCTATT TTTATTAGTT TTTAGACCAA AGAAAGTCAA ATGCCATTTT
57301  ATATTTGACA ACGCTTCTTG TATGTTTATA CCAGATAAGC TAGATTTCAC CTTTATATTG
57361  GTGTGTTATT AATGTTAAAC TTAGTTTTAA TAAAACTCTG TAGACATATT TATTTGATTT
57421  TTAATGTCTG ACCATAAGGT AAGATTTTA TAGACTTTTC TTTAACCTTT TATAATTTTT
57481  GTTAAAGAAC AGGTTAGTGC TTTAAGAAAA ACCCGTTGTG TTTTTATTTT AATGTTCAGT
57541  TCACAGAAAA ACTGTATGAT ACCCCTTAAC TTTAGCCAAT ATGTTTAGAC ACAGAATTTT
57601  CTTTACAATT AAGGTTTCAA AACTTGCTTA AACCTTCAAA ACAATTTTTG TAACCTTTTA
57661  ATGTAGGTAA AAATCCACAT TCTTATGCAT CCTCATAATC CTTTTACCAA AGGTATATTT
57721  TACTTTCCTT ACATACCTTG CACATAAACT GTTATTCAA TAGTTTTACA TTTAGAAGGA
57781  GGCCTAATTA CTTTTAAATT ATACAACATT TCTTACATAA ATTTATTTTT CTAACACACA
57841  TTTTTTTCAT GACTTTCACA GACAATTCTT CGACATGCCT CAACTTTCTG ACTTATTGCA
57901  AACATCCCTT TCTTTAAACA ACTAGTTAAT TTATCTCAGG ACAAGGATTT TCCATACAAC
57961  ATTCTTTTTT ATATAAATTC TGCCTCCTCT TTATTTCCTT TTTTTTTTTT CCGAGGATGA
58021  TAACCATTCT TTTCCAAAGC GAACTTCTTT TATGTCTGTG GACTAGACTG TCTAAGGCCA
58081  CAAGATTAGA AGTTACTATA ATACATGTTA CACTGTTAAC TTTTAGCAAA CTTTACTTTT
58141  GTTGAAAACC TTGTAAGTTT GGGATTTCAA TTATCCTTTG CTATTAATAA GACCTTATTT
```

```
58201 AGTCCAAATT AACTTAGAAT TGGTATAGAT GGCTTTTTTT TTTTTTTAAT TACCTGGGAG
58261 GAACCATCTA TCCTCCTGTC CTGAAGGGAG TTCCTCCTAG GTCTGGTCAG AGCTTTGTAT
58321 GGTAATTAAG ATTTAGATCC CCTGTTAGGA AACCTGCCGG GTTAAGAGAA TTTTCAGTGG
58381 TTAATGTTAA ATCATCTTCT TTTTTCTTTT TTCCTTAGGA TACTTCTGAA CCGGTGAGGT
58441 GTGCTCACAA TGAGGTTTCC TGTAAAAGTT ATTTTTTTAC TTTCTTCTGT TAGCAAAGCA
58501 GTTGCCGCTA CAGATTGAAT GCATTTGGGC CATCCGCGGG TTACTGGGTT AAGGATTTTT
58561 GATAGGAAGG CCTTAATGCT TTTGGAATAT GCCCTGACAA CAAAGTGCCA GTTCCTTCCC
58621 GGTGTTCAGC CACTGCGTTG ATCCTCCACG AGGGCCTGCC ACGTGCTGCT CTGGTGAGGC
58681 GTTCCACCGG GGCAATTGCC TACCTGGGAG CGCTCTCCAG ATCTGTGTCG CTCAAACTGG
58741 CTGGAGTTCC CCGTAGGGAT GCTCCACAGG GCAGGCCTAA GTCGCCTAAG GGGCTGCCTT
58801 GACCGTCCGT TAATCACCTC TGTCTCCAAA AACCAGCTCC CTGAGTGAGC AATTCCTGTC
58861 CCTTTTAAGG GCTTACAACT CTAAGGGGGT CTGCATGAGA GGGTCGTGAT TGATTGAGCA
58921 AGCAGCGGGT ACGTGACTGG GGCTGCATGC ATCAGTAATC AGAACAGAAC AGAACAGCAC
58981 AGGGATTTTC ACAATGCTTT TCCATACAAT GTCTGGAATC TATAGATAAC ATAACCTGTT
59041 AGGTCAAAGG TCGATCTTTA ACCAGACCCA GGGTGCGGTG CCGGGCTGTT TGCCTGTGGA
59101 TTTCATTTCT CCCTTTTAAT TTTTACTTTT TCTTTCTTTG GAGGCAGAAA TTGGGCATAA
59161 GACAATATGA GGGGTGGTCT CCTCCCTTAA TTTAAACAAA ATTTTCAAAG TCCTACCCCA
59221 AGTAAATTGG CAAATATTAA TAAAGTTATG GCATAGAAAA TAAAAATGAT TGTAAAAGGC
59281 GTAAAGATAT TTCTGTGGGG AAAACATTTG TTCATTAGTT ATCAGTTAAA ATTCTGTGAA
59341 AAATAACCAC TAGAGACCCT AAAGTACCCA GGGCTAATA ATAAGAAGGG AGGAACACCC
59401 TCTCACTCCC CACCGTTACC TGCCCAGAAG GGAAGAGGAA GAGGGTGACT CCAGGAGAGC
59461 TGTGGTCTCC CCTCCCCATA TGTCCACATA TACCTGACCT CCCCTCCCCA AAATATATAC
59521 CCAATATCTC TCCCATATAT ACATATTTAT CTGACCTCTC CACATATGTA TACCTAAACT
59581 TTCTCTATAT ATCCACATAT ACCTAACCCT CTCACACACA TATAGCTGAC CTCCAGTGGA
59641 GGAAAATGGG GAAGAGAGAA GAAGTTATCA AGGATAAAT CTAGGTCATA CTCAGAAATG
59701 TGAAAAACAA AAACCACACA CAGAAAAAAA AAACACACAC AAAAAAGAAA TTGATAAATT
59761 TGTTTGTGTC AAAATTAAGA ATTCCGGTTC AATGAAGGAT CCCATGGATA AAGTTAAGAC
59821 ACTGCTGTAA GGATGGTAGA GAATTAAATG TCTGAATCAG ACGAAAGGAT GAGTAATTAG
59881 AATGCACAAG GCCAAGAAGA ACAAAACAGA AACTCCACAT AAAAAATGTA TGAGGCCGGG
59941 CGCGGTGGCT CATGCCAGTA ATCCCAGCGC TTTGGGAGGC CAGGGCGGGC CGATCAGGAG
60001 TTTGAGACCA GGCTGGCCAA CATTGTGAAA CCCCATCTCT ACAAAAAATA CAAAAAATTA
60061 GCCGGGCGTG GTGGTGGGTG CCTATAATCC CAGCTACTTG GGAGGCTGAG GCAGGAGAAT
60121 CACTTAAACT CAGGAGGCAG AGGTTGCAGT GAGCTGAGAT CACACCATTG CACTCCAGCC
60181 TGGGTGACAG TGTGAGACTC TGTCTCAAAA AAAAAAAAAA TTATATATAT ATATATATAT
60241 ATATATATAT ATATATATAT ATATGAAATA AATGAACAAG AAATTTAGAT ACAGGAAAAT
60301 CCAAAGCACT TGGTAATGAA AGAAAGGTAA AGTGATGTGT CCTTTTGCAT TTAAAAGAGA
60361 GCATTAACAA ATTAGAGAGC TGAATAATGC TCAGTATTGG TGTGGATATG GAGACTCAGG
60421 AATCCTCATA CACTGCTGAT GGGAGTGCCC ACTCCCTGGG AATATTTTCC AAATATCATC
60481 TCAAACATAT CCCATAAAGG TGACAGGAAA GTGTGGGCTG ACTGATATCC TTCACTGAGA
60541 GAGGTGGAGG TAAAATGAAG TCACTGCACA ATATAGAGTT GGAAGCAATG GATTAGATGT
60601 CCACATAGTT ACGTGGAAGA ATCCGTAAGA TACACACACA CACACACACA CACACACACC
60661 TTTGTGTATA TTGTTCCTGG CAGGTAGGCA TGGAGGTTTA GAGGCTTTCT ACATCACACC
60721 TACTGCACAC AGTAAATGGC CAGGCTGAGC ACTGACTTCC ATGAAGGGAG ATTGAAGGTA
60781 AGAGATTGAA GATTGTTCCC TGGTCTGGGA CCCTGCAACT GAATATGCAG AAAAAAGTAC
60841 ACCCCGCCAC CCCGCTTCCC ATCTTTCCTA CCTGATTAGA ATAGCTTTTT CAGAAAACGT
60901 TGGCCAGGGG TTGTGGCTCA CACCTGTAAT CCCAGCACTT TGGGAGGCTG AGGCGGGCAG
60961 ATCATCTGAG GTCAGAAGTT CCAGACCAGC CTGGCCAACA TGGCGAAACC CCATCTCTAC
61021 TAAAAATATA AAAATTAGC AGGGCATGGT GGCACACACC TGTCATCCCA GCTACTCGGG
61081 AGCCTGAGGC AGGAGACTCA CTTGAAGCAC AGTGATGGAG GTTGAAGTTA GCTGAGATCT
61141 TGCCACTGCA CTCCAGCCTG GCAACAGAG TGACACTTTG TCTCAACAAC AACAACAAAA
61201 CCCACCAAAA CTTTAAATCT ACCTATGGCC AAATGCCTGC TAAAATGAGC ACCCAAGAAG
61261 CAGTGTTCAG GAAAGTCAGA TGAATACCCT AAAATTAGAT GCAATGTTGG CTGGTCACAG
61321 TGGCTCAGGC CCTGTAATCC CAATCCTTCT TGGGAGGCCG AGGCGACAGA TCGCTTAAGC
61381 TCAGGAGATC GAGACCAGTC TGGACAACAT GGTGAGACCG TGTCTCTACA AAAACGTACA
```

Figure 1 (Page 19 of 73)

```
61441 AAAATGAGCT GGGAGTGGTG GCGCGCACCT GTAGTCCCAG CTACTCAGGA AGCTGAGGTG
61501 GGAGGATCTC TTGAACCCAG AAGGCGGAGA CTGCAGTGAG CAGAGATCAT GCCACTACAC
61561 CCCAGCCTGG ATGATAGAGC CAGACCCCCA TCTCCAGAAA AAAAAAATAA AGAGAGAGAG
61621 AGATGCAATA TTTAGGGTTC AACAAGACTG AATTTCTGAC TCCTTTCCCT ACCTCTCCAG
61681 CATGTTAGAT TCTGGGTCCT TCATCCTAAC CCCCTGTTCA TGCCATAGCC ACCCTGTGGT
61741 ACCAACTTTG GAAGCCTGGA TCTTCATCCC CTCATGATAA TGAGTGTCCC ATCAGGTCTC
61801 CATGCTCAGC TTGGCAAGAG TATCTGTCTT CTCCTCATGG GACGGTCACA TTCACCCAGC
61861 ACTGACAGGT TCCATTCCCA CTAGGGTGGC ACCCTATATG GTCTGAGTCC AGGCCTTCCT
61921 GGTCCCTCAG TAATCTCAGC ATGGTAGCAC AATCGAAAAG GGCTAGGCAC GGCAGCACCA
61981 TTTCCCACCA AGAGGTCTGA TGGCTCATCA CATAGACTGA AGGAGATTCT GAAGAGCAGA
62041 GGTGGAATGA AGAATGAATC GTGGGCTCTG CTCTTCCTAG GCCTGTCTTC CTCTCTCCCG
62101 AGATGTTAGC TAACTCATGA GAGCCAGAAA CCAACTGCAG GCTGGCCTCA GGCACTTAGG
62161 TAGTGCTTCA GCCTCAGCAG TCCACATTCT AGGAACCCTC ATAATATGGG TTGAAGTATG
62221 CATTCCCACA AAAATAAAGT TGTTGAAGTC CTAACCACCA GTACTGAAAT GGGAAAAGTT
62281 CCCTTGTCCC GCTCGCATGG CATGTGATAG GAGTGTGGCT AATTTCTTCA GTGCCTGGCT
62341 GCTCAAACCT CTAGGGGAAC ATTAAGACGG GCAGGTTGTG GGTCTCCAAC CCCATGACCC
62401 CACCACAGTG TCTAGGGTTG AATGTTTACA GCTCCTGAAG CCACAGTGGG TGTGTGTTAC
62461 AGGGTGCTCT TTTAGTTTTG CCATTTATAG GCAGCTGGTG TTAACCAACT CAATTAGACC
62521 GTCTACCTTG TCCCAAGGAC AGAAGAAGGC TTTCTGTATC CCAGGTTCTT GCCTTGGTGT
62581 ACCGGAATAA ATCAGACCAC ACCTGGGCTT AGAGAAAGAG TGCAAGGTTT TATTAAGTGG
62641 AGGTAGCTCT CAGCAGTTGG GCAAAGCCAA AAGTGGATGG AGTGGGAAAG TTTTCCCTTG
62701 GAGTCAGCCA CTCAGTGGCC CAGGCTCTCC TCCAACCACC CCAGTCAAAT TCCGCCTCAT
62761 TTTGCCAGGC AAACGTTTGT TGTGTGCTCT TCTGCCAGTG TGCTCCCCTG GACGTCCAGC
62821 TATTCGTGTC TTGTGGCAGG CCAGGGGAGG TCTTGGGAAA TGCAACATTT GGGCAGGAAA
62881 ACAAAAATGC CTGTCCTCAC CGTGGTCCCT GGGCACAGGC CTGGGGGTGG AGCCCTAGCC
62941 GGGGACCACG CCCTTCCCTT CCCCACTTCC ATATCATTTA AAGGGACCAT GCCCTTCCCT
63001 TCCCAGCACT TTCCCCCTCC TGTATCAGGA CCTGTGAATG TGGCCTTATT TGGAAATAGG
63061 GTCTTTGCAC TTCATCAGTT AAGATAAGAG TGGGCTCTAA CCCAACATAA AGGGTGTCCT
63121 TATAAAAAGG AGAAATGTCA TACACAGAGA CTGACACCTA TAGAGAGAAA ATGTGGTGAG
63181 TAGACACAGG GAGAATCACC ATTCAAGTCA AGCAATGAGT CTGGGGATAC CAGAAGCTGG
63241 GAGAGAAACC TGGAACAGAT TATCCCTCAT TGCCTTCAGA AGGAATCAAA CCTGATGATA
63301 CTTTGATTTC AGACTTCCAG CTTCCAGGAC TGTGTGACGA TAAATATCTG TTGTTAAGCC
63361 AACGAGTTTG AGGTACTTTG TTACTGCAGC CCCAGAAAAC TAATACAGTA GGTACTATGG
63421 ACTGAATTGA CTCCCCGTCG CAAAATTCAT ATGTTGAAAC CCTAACCCCC AGTGTGATGG
63481 TACTTGGAGC TGGGGCGTTT GGGAAGTCAT TATATTTAGA CAAACTCATC AGGATGTGTC
63541 TCTCATGATG AAATTCATGC CCTTATTAAA AGAGACAACA GGCCAGGTGC AGTGGCTCAT
63601 GCCTGTAATC CCAGCACTTT GGGAGGCTGA GGTGGATGGA TCACCTGAGG TTGGGAGTTT
63661 GAGACCAGCC TGGCCAACAT GGTAAAACCC CATGTCTACT AAAAATACAA AAATTGGCCA
63721 GGTGTGGTGG TGCACGCTTG TACTCCCAGC TACCTGGGAG GCTGAGGCAG GAGAATCCCT
63781 TGAAACCAGG AGGTGGAAGT TGCAGTGAGA TCACACCACT GTACTCTAGC CTGGGTGATA
63841 GAGACTCCAT CTCAAAAAAA AAAAAAAAAA AGACAATAGA GCCAGGTGCT GCAGCTGATG
63901 CCTGTAATTC CAACACTATG AGAGGCTGAA GCAGGAGGCT CGCTTTAGCC CAGGAGTTCA
63961 AGACCAGCTT GGACAAAATA GTGAGACCCC CAACTTCTAA AAATTTAAAA AATGAACTGG
64021 GTGTGGTGGT ACACATCTGA GGCTCCAGCT ACTCTGGAGG CTGAGGTGGG AGGATTGCTT
64081 GAGCCCAGGA GGAGGCTGCA GTGAGCCATT GCTGTCCAGC CTGGGCTACA CGAGAACCTG
64141 TCTCGGGAAA AGGAGAAAAC AGTGAGACCT CTTTTTCTCT CCTCCTTCTC TCCACTGCCT
64201 AAGCCCTACA AGCACAAAAA GGACACCACA TGAGCACATA GTGAGAATGC TGCTGCCACC
64261 AACAAGTCAG GAAGAGAGCG TTCACCTAGA AACTGAATTG GCCAGCACCT GGATCTTGGA
64321 CTTCTGAGCT TCCAGAACTG TGAGAAAGTT ATTTTTTTTT TAGCGACTAA GTCTATAGTA
64381 TTTTATTACA GCAGCTCAAG GTAACTAACA TAGTAGAAGG GATGAATTAT GGAGATCACA
64441 AGTCCACGCC TCCAGAAAAA GACTTCCCTA AAAATTAGTC TGAGCAAAAT TCGAATGATG
64501 AATTATTTTT AAGAACTTTT AAGGGATCTG ACAAGTTTGC AAGAGCTAGA GAATGCTTTA
64561 CAACGTGATA ATAGAATGCT CTGTGATGAC AGAAATCTTT CCACACTGTT CAAAACTAGC
64621 TACTGGCCAC TTGTGACTAT TGTGCACTTG AAATGTGACT GGTGTCTGAG GAGCAGAATG
```

```
64681 TTTAATTTTA CTTAATTTTA ATTCATTACA ATAGCTACAT GTAGCTAGGG GCTACTGGAT
64741 TGAACAGCAC AGCTCGAGTC TTTTAGAGGG AGACAGGACT CACCAAGATG GATGCTGGTG
64801 GCCAAGCAGC AATGGCAGGT AGTACACACA CAAGAGGCAG ATGATACAAC ACATCCTTCC
64861 CAAACCTGGA GATAAGCTCA CCCCACAATC CCGCCGCTGA AATAGAGTTG ATGTTACCAA
64921 TGTGCATTTT TATGTCCTTT TCCATACAGA AAGATCATTC AGCAAGTACT ATGGTACTTA
64981 AAAAACAACA TTCAATTCAT TATTATGACA AAATTAAATT AATAGCTCTT CCTTAAACTT
65041 TTAAATTCAA TTTACAATGC TTACTATTGG CATTTATTAA TCTACCAATT TTTTCCCATA
65101 GAACCCATAG AACAAATAAT CTACCAAATT TTTAACATTC ATTTTTGGCA AGGCTTTTGC
65161 AATTTGACGA ACTTTAAGAA GAAAACTTAT AAATTGCAAT TTTTAAATCT GACATACTGG
65221 ACTTTTAAAG TATCCAATTG ACTAATGAAC AAAACTGCTC CAAATTTTTC AATTCTTAAA
65281 AATCTTAAGA CAATACTTAA TATGGCAAAT CTTAACTTCT TAAACTTTGT AAGAATGCTA
65341 ATCAACTTAG ATTGGTATAA AGTTGAGTTA AAAATCACAG GATACATCAT CTCAGCTATA
65401 AGTTTTCATG AGTTGAGTTT TTACAATCAC TTGAAATGCT TAGAATAGGA AATACGTATA
65461 AATTATTTAA CATAAAATAT TGTTACAAAA CCTCTGGAGT GTCAGTTTCT CTGGCCAGAC
65521 TTTATGCTGC AGCACCTTTG CCTGAGTTCT TGTCCTGCAT CCAGGAAGAA TTAGGTACAG
65581 AGGCAAGAGT CAAGAAGATT AGTTTTCCAA TAGTTCAGCT CACCTAGTTA ACTCCTGTTC
65641 ACAATCTTCA AAGTTATCAG AAACCTGCAA TTGAGGGTTA TAATCCATTC TTTGCAGAGT
65701 TTCAAAACAA GACAACATTT GTCTATGAAT GTTAAAATGT CCTAGGGTAG TCACAGTCAA
65761 AAACACAATT GACAAAGAAA TTTAGTCACC TCTGTGATTT ACAATAGCCT AACACAATAA
65821 CTCTAATTAT AACTGATGAC ACAAACTCAG ATATCAGAAC TCTAGAAATC CCCTATAATT
65881 TTGGAACACA CATTCACAGT TTTCACTGAA ATATGACCTG AAGATCAAAT ATCACCTTAT
65941 TTCAACAATC CTATATAACT AAACGTGTCA AATGATCCTG TTTACCTCTC CTTTGGATAC
66001 TCCAGGGGCC CTCTGTAGCA TCCAAAAGTT AGGGGTTAGC AAAGACAATT TTGAAGCTGT
66061 AAAGGCTCAA AACACTTAAT GAACCTCTAG TCATATCTGT TCTCTACTCA CTAAATGCTA
66121 GTAGCACCTC TCAGTTGTGG CTAAGCTGGG AGGATCTCTT GAGCCTAGAA GTTTGGGGAC
66181 GCAGTGAGCT ATGATTATGC CACTGCACTC CAGCCTGGGC AACAATGCAA AATCCTGTCT
66241 CAAAAACAAA AACAAAAAAC AAATTGCCTA TGCTGTGGTT ATCTCACAAT TAATAAAAAG
66301 GAAAAAAAAA GTATGCAGTC TTTGTAGGTC CTTGGGGTTT GTTGGAACTC AGAAAACAAT
66361 ACCCCAAAAT AAAGACCGCA GAAGCCAAAG TTTTTCTCTG ATCTTCTCCT GCCCTCCTGT
66421 CTCTGAGTCC CATTCTCCCC GGAGTCTAGC CATAGAAATG AGAATTCCTC TTCCTCAAGT
66481 TAGGTCATAG AAATCAAAAC ACCTTTTCCC CAGAGCCCAG CCATAAAACC TAAAAATATT
66541 ACTCTAACTT TCCCTCTGTT TTTCTGTGTA AAAACTGGCC ATAAAGAAAT TATCTGAACT
66601 ACCTTATTTG ATCATAGATC ACCAGACCGC ATTCCAGAGA GGATCCAGAA GGAAGGAATG
66661 CTGCACAGAG AGGCGAAGAA GAATCTAGAC AGACAGGCCT TGCTGGGTTT CCCTACTCTG
66721 TTTATTAGCA ATCCTATTTC TACACGGCGG CCCATACTTT GTTGAATCTA AAAAATAAAA
66781 ATGGACAATT TCCCCTGTAC ATGTTAATAC ACATTAATAA ATTGGATATA AATTGGATAA
66841 TTTATTAATA TACACATTAA TAAATTGGAT GCAGCCGGGT GCAATGGCTC ACGCCTGTAA
66901 TCCCAGCACT TTGGGAGCTG AGGCGGGCAG ACCACGAGGT CAAGACCACC CTAGCCGAAA
66961 TGGTGAAACC CCGTCTCTAT TAAAAATACA AAAGTTAGCT GGGCGTGGTG GCACATGCCT
67021 GTAGTCCCAG CTACTGGGGA GGCTGAGGCA GGAGAATTGC TTGAACTCGG GAGGCGGAGG
67081 TTGCAGTGAG CCGAGATTGC GCCACTGCAC TCCAGCCTGG TGACAGAGTG AGACTCCGTC
67141 TAAAAATAAT AATAATAATA ATAATAATAA TAATAATAAT AATAAATTGG ATGCATTTTA
67201 TCCTATTAAT CTTCCTCTTG TCGGTGGTTT TCAGCGACTC TTCAGAGGCC AAAGAGTAAG
67261 TTTTCCCTTA GCCCTACAG GTTCTTATGT TTAATTTGTT ACTCTCATTT AAGACATAAT
67321 TAAAGTGGCT TCTCCATGAA GATTATTTCT GCATCCATTA TTTGGTAAGA TTGGCCGTTT
67381 TCTCCTTTGA TCTCTACTTC ACACTGACCC ACATAAAACA TCACTGCCTG TTTTTTTGTT
67441 GTTGTTGTTT GGAGACGGAG TCTTGCTCTG TTGCCCAGGC TGGAGTGCAG TGGTGTGATC
67501 TCCGCTCACT GCAAGCTCCG CCTCCCGGAT TCACGCCATT CTCCTGCCTC AGCCTCCTGA
67561 GCAGCTGGGA CTACAGGCAC CACCACCAA GCCCGGCTAA TTTTTGTATT TTTAGTAGAT
67621 ACGGGGTTTC ACTTTGTTAA CCAGGATGGT CTCGATCTCC TGACCTCGTG ATCGGCCCGC
67681 CTCAGCCTCC CAAAGTGCTG GGATTACAGG AGTGAGCCAC TGCGCCCGGC CCCGTTTTTT
67741 TTTTGGTTT TTGCATGTCT TCTCCCTTTT ACTGTAAACT ATTTCCACTA CCAGCGTAGT
67801 TATCATTTCT ACTGCTTAAT AATTGTTTTG GGAAGTGAA TGCATCAACC CACATGAATT
67861 TCTTGTCTAT TTGACAATTT ATTCTCTTTA GGAATAGTAT TAACTCCTAA GGTCCTGGGA
```

```
67921 GCCAGTCTCT GTACTTGGCT GCTCCAGGGT CCTACTTCAG TTTCCCAGCT TCTCAGTACT
67981 GTCACTGTCA ATTGTGGGTA ATAATTATTT TTGTCCACCA AAAGACTCTG TATGTGAATG
68041 AGTTTTGAAA TCTGCTGAGT AATACAGTGT CAACCCAGTT AATGATTTGC CGGGCGGCTT
68101 GATCAGGGGC TGTCCAACTA CCGGCATTTT GATTTGGAGC GTCATCTAGT GTCTGAAAGC
68161 ACAAACAACA TCCTACATTG TAAATGCCTT TGGCTACAGA GATTGAAACC AAAGCAAACC
68221 TATGTTTTGA ATTGTTATTC TTCAGCAGTT CTGCTAGCTT TGAAAAATCT AAAAGTTAAA
68281 AAAAAGCTTT ATATTTCATT TTCTGCCTAA ACTCTTTAAA ATTGCTAGTT GACAATTAGA
68341 TATTTTCAAT TTAATGAAAT TTTTTTTTAG TTCACAGATT AATACACAAT GGGGGAGGGT
68401 TCTTATTCTG TTGGACTTTT ACATAACCTC CACTTTAGTG CAGTCTGCTT TATGGGGTCT
68461 TGTTTGAGGT GTGTGTGTGT TTAAGGGAAT GTGGTTTACA ATCAAAATAT TGGGTTGCTC
68521 TTAGGCACAT TGTAAAGTCA CACACCTGTA TTCTTATTGA TACATAATGA TTAATAACAT
68581 TATTATTACA GCCTGATCAC CATCATTATT GATATATCTA AATAATGAAT TTTATAATTT
68641 TGCTTCCTGT CAGGCAAGAG CCAATTTCAG TGCTACCATG TTTGTATAGC AGTATTTATG
68701 TCTGTCATCC TCAGTCATTT TACTTCACTT GTTCTTAGCC AAACGGCCGA GAAGCGATGG
68761 TCATTTTACT TCAAAAATGA AAGAATTAA TATTTTTACG TTTCCCTTAA AGACCCTATG
68821 TTTAACCTCC ACTCCTGGGT AAAATGGTCT AGTCCCTCCT TTTCATATCA TCTCTGATAT
68881 CTTTTGCACA GCCACTATTA CCTACCGTTT TCTAGATCCC TATTCTTCAA ACACCACCAT
68941 GAAGGTAGAG CCTGTCTGAA TTATTTTCTT GTCCCCTGAA CTCAGTACAT TGTTAGGCTT
69001 CTTGAAGATG TTGATCAGTT GTTTGTGGAG TGAATGAATC AGCTAGCATG ATTTTTCTAG
69061 ACCACTGAGA CAAGTGTCTA AGACACTTGT TCCTTCCCAT GTTCTTGCCT GGCTGTGCAA
69121 TCCATGCAGT CTCATGGCTT CCCAGTGCCT CAGAATTATC CCTGTCAAA CAGGCATTAT
69181 AATTTCTGTC CACTGAAAAG GACAAAAAAC TAAGTGTATA GCTAGAAGTT AAAAATTACC
69241 GGCCAGGTAC TGTGGCTCAC TCCTGTTATT CCAACATTTT GGGAGGCTGA GGCGGGCAGA
69301 TCACCTGAGG TCAGGAATTC GATACCAGGC TGGCTAACAT GGCGACCCCG TCTCTATCAA
69361 AAATGTAAAA GTTAGCCAGG TGTGGTGGCT CGCACCTGTG GCCCAGCTA CTCAGGAGGC
69421 TGAGGCAGGA GGATCGTTTG AGCCCTGGAG GTTGAGGCTG CAGAAAAATA GGAATATACT
69481 CTCTTTCAAG AGTTCGTGGT TTTGACTGCC ACCTAGCGTA CATCAGAAAA ACCGCATGAC
69541 ATAGGAAATG CCTGTGACAG AGGGGTAAGG TGAGAGAGGT TGATGAAGAA TGTATTGAAG
69601 GAGTGAAAAC GCTTCCATCC CTCTACTTAC TAAATATATT AGTTAAGTAG TTGGGGCATA
69661 TTTTAATTCA TGCATTTTGT AGATAGAAAA ACAAAAGTTT TATTCTGTTT GATTTAGTTG
69721 ATACTTTAAT ATGTGTGTGT TTAGGATGCA TGATTTATAA TCAGTCTGCA GCACTTCTTG
69781 GAGAAGTCTG AATTCTCATT CTCCATTTCC TTATTGGCAA CGTGAGAATG ATTACAATGG
69841 TGGTTGTCTC ATAGAATGCA GGGAGTCAGA ATGAAAATAG TCCATATAAT GCCTGGTGCA
69901 GAGGAAGGGT TCAGTTAACT GTCTGTATTA ATATTACTGA TAACAGTCAT GACAAACAAA
69961 AGCTTAACAA CAACACCACC AACAACAGTT GCAGAATTGA GCCACCAATT TGCACACAAG
70021 ATTGTAGGTA GGATGTTTTA GAAAAGTTAT TATTTAATAT ATGTATATAT TTTTGTACTT
70081 AAAATATGTC AGAGGTTGTT CTAAGAACTA TTTAAATGTT AACTCCTTAA TCCTCATAAT
70141 GACCCATGAA ACAGGTAGGC TTATTATTGT CTCTTTACAT GTGAGAACAC TGAGACACGA
70201 AAAGGTTTAT TAACTCACCC AAAGTCACAC AGCTGGTAAA ACGGCAAAAT TGAATTTGAA
70261 CTCAGACATT CCAGGTTCCA AGACAGTCTA ATTATTCTTT TGACTAATAT ACTAAGCTGC
70321 CTCTGTATTT TTCCTTGATT ACTTTGTAAA AGTATGAGGA AAATATAAGT GCTTCAAGTA
70381 ACCATGAAAA ATATAAACAA TCTATGTATC AACTGAAGCA TAATTACAAA TCCTTTGATA
70441 AGCAAACATA ATAAAAATTT GATATCAATC AAAACTTTCA TGTAATGTAA GCAGGTTGAG
70501 ATGAATTCTA TAGTAAAAAA GTGCAGAGTG CTGGAATACC ATGCTCCTAA TATATTGGCT
70561 AGGCACACCT GCCTGCTATC AAAGGTATGC ACACACCTTG GATACAGAAA GTTGGGACTG
70621 GGTAGTTATG TGAGTGTCAT CAGAATTCTT TCCCACTTGG GAAAGAATTG TCCATCATAA
70681 GCTTGGATGA TGGACAAGGA GTGAGCTCCC AGAACAGTGA TGTGGGGATA CATCCTCACA
70741 TCACAGTGAG AATGAGTGTT CTAGACTGTT TACACACCTA CCACTCCTAA ATGCACACAT
70801 ATAATTGCTT GCACACACAC ACATACACAC TCATCTCTTC TCTGGTGGTC CAGCTCTATC
70861 TCTTATCATT AGGCTTCTTG GGGCTAGTAC CTAGGGCCTG TATCCTTTCA GAGGCAGCTA
70921 AGGGAAGCAC ACATAATTAG AAAGAATGAA CCAGCTTGTT GGATTTGGTC TCTTCGCATC
70981 CAGCCCTCCA AGTTAAGGAG AGTACCATCT TTCTTAGGGT CACCAAAGGA AAAAAAAAA
71041 AAAGAAAGAA ACAGAAGGAT ATCATACAGC AAGGATCTAA TGCAAATATG CCTCAAATGA
71101 GAGGCTACTG TGTGCTGATC CCAATCCCAG GAACTGTATG CACATTATCT AATTTAATCC
```

```
71161 TCACTGTATT TCTGGGAGTA TTATTCCCAT TTTACAGAGA AGGAACTTGG CAGGGTAACC
71221 AAGCTCATGA ATGGAGAAAC TGGGATTAAA TATAAAGCTT CCTTGCTCCA GAACTGCTGT
71281 CTTTCTGCTC TTCCACACTA CCAGCTCAGC TGTGCTCTCT ACATGCAGGC AGTTTTACAA
71341 GTTTCAGATT AGCCTGGGAC TTCCAGGGTT TTGAATGGGT TAGGGAATGG GGAACTTTTG
71401 GGTTTACTTT CCATTTTTTC TTCATACATA TGTAATATAT AACATAAATC TATGGTATAT
71461 ATGATAAATA TATGGCTACA TATGAACTAT ATAATCACAT ATATGCATTA TAAATAAATA
71521 TTAATTTTAT AATATTTTAA AGGTTATCAA ATAAATATTA ATATAAATAA TTAAATAATT
71581 AATACTCAGC TTTGTTTTCC AAAGTGATAA ATGCCTATAT TTAGCAAAAT ATTTTTTGGA
71641 GGCCTGATAG TTTTTAGGAG TGTAAAGAAG TCCTGATATC TAAATGTTTA AGAACCACTA
71701 TTTTAGGCTG TTGTCTTCTG TCTTATTTTC CAGCTAGAC TGGTAAATAC TTGAAGGCAA
71761 ACGTTTAGCC AGCACATTAA CATTTATGT TTTTATTCTT TTGTGCTCTC AGTGGCTGTG
71821 TCTTTTCTAT CGATTCTCA CACTGTATGA TGGTTATATT TGTCTGTATC TGTCCCACCA
71881 GGTATAAGTT CTTGAGAGGA CACACTGCTA GGCTGATCTT AGTTTTATT ATTTCTCCTG
71941 GTGTCCTGTG CTTAACAAGT GCTCATTAAG TGTGTAAAAA CACAGCACAG TAAAAAACTA
72001 GACATTAAAA AATAATGTCA ACCAATCTAT TGAAATTTGC ATTTCCATGT TTCTTCCAAT
72061 ATAGTCATTG TGTCAGGTTA TGTACTTATT CTGATGAAGA CTATTGCCTA ATATACGTTT
72121 GCATCTTGTG CTTTATAACT GCCTTCATAT AGACACAGAT TGAGAAGGTG TAAAAATGTG
72181 CATATCCTCA CAATTGACAA ATTCTTATCC TTTGAGGGTA GGTTTGACTT TCTGAAATGC
72241 TTTGACATCA TTTGAAAGAA GCTTGAAGAA TAAGATAGCT GTTAATGACC CAGTTTCCTA
72301 TGTCACTTAT ACAATTATAA TGGCAATTTC AAAATGTTAG GTAAATATAT TTTGCAATAT
72361 ATTGTTCCTT TTGTAATACT CTCTATGTAT TTATTTATAT TTTTAAATTT TATATTTATG
72421 TATTTATTTT TCTGGACAGA GTCTTGCTCT GTTGCCCAGG TTAGAGTGAA GTGTTGTGAT
72481 CATAGCTCTC TGCAACTTCA AACTGCTTGG CAAAAGTGAT CCTCCTGCCT CAGCCTCATG
72541 AGTAGAGTAG CGGGAACTAC AGGCGCATGC CACTGCACCC AGCTAATCAC TATTTATTAT
72601 GCTCCTACTG TGTGCTTTAG TATATTTCT GTTGTTTCT GCAACCCATT TTGAGGGCGT
72661 GTTAGGGAAT ACAGATGCAG TAACTTTCGT CTCAGCCCTT GAGGTGAGGA AATATTTAGC
72721 CTCAGGTTTA ATCTAATTGT TGGCCATTTG CCTTCAAAGA TTGAAATATG AGCAAAACTG
72781 TGGCTCTGGG TTATATGTTA AAAAAAAGTT TATGGGGCTG AAGCCAGGCA ACAGACAAGA
72841 GCCCCTACAA TCTTATTTAG GCTGAAAATA TCCTGGAGTC CCTGTATTGT TGGTCTCAAG
72901 CAGATAGCAA CACTAACACT TACTCTTTGA GGCAGGCACT GCCAGTGGGG TGGCTGTTAT
72961 TATTAGCTTC ATTAATTGGT GAGTCAGGAA AAAACAGCTT TAAATCATTC AAAGTTCTGG
73021 CCTATACAGG ATTTAGTAAT ATTAGGTTAG CTACATCCAA AAGATGACAG AACCCTACTC
73081 TAAGGCTGGG CTTGGTGGTT CACACCTATA ATCTCAAAAC TTTGGGAGGC TGAGGCAGGA
73141 GGATCACTTG GTGCCAAGAG TTTGAGACCA GCCTGAGCAA CATAGTGAGA CCCCTGTCTC
73201 TATCAAAAAC AAAGAACTCT AATTGGCATA GTAGAAGGAA AAAGTGAAAG AAAAACCAGC
73261 TGTCACCCTC ATTCCTTACA CCTGTCCTAA CAACTCCTCT CACTATCCTT TGAATATATC
73321 TTGGCTGTTT GAGTCTCTCT CTAGCCCCAT TACTGCTGTT TGGACTTGAC ATTTTGCTCT
73381 GCATTTTTAA CTTTTCTACC AGGGTTTCCA GACCCTGAAG AGTGTGGCAT GAAACAAAAC
73441 TAGTCAACCT ATAATATTTA TGATGTGTGT GTAAATAAAA GAATACACAA TATATTGCAT
73501 TACAATATTT TAACTGTGTC CTCAATTTGT TTGTGGCTTT CTTGAGGACA TCAGTTTTGG
73561 GTGGGACGAC CACATCCTTA ATCTGAACTT TCCCTTGGAG GTCATTCTTT TTTTTTTGAA
73621 ATAGAGTCTC GCTCTGTCAC CCAGGCTGGA GTGCAGTGGC GCAATCTCAG CTCACTGCAA
73681 CGTCCGCCTC CTGGGTTCAA GTGATTCTCC TGCCTCAGCC TTCCAAGTAG CTGGGATTAC
73741 AGATGCACGC CACCATGCCG AGCTAATTTT TGTATTTTTA GAAGAGACGG AATTTCACCA
73801 TGTTGGTCAG GCTGGTCTTA AACTCCTGAC CTCATGATCT GCCCACCTCA GCCTCCTAAA
73861 GTGCTGGGAT TACAGGCGTG AGCCACCCCG CCCGGCCAGA GGTCATTCTA ATAGACTTTT
73921 TTTTTGTTGT TGCTCACAGG CTTGTTCAAT CTTATTTCAA AATTTGAGAA ATACAGTTTC
73981 CATGGAACAC CAACCAGATA TCAGGTTGCT ATGGAGTTGA TAGTCAAAAG CTTTGTATCT
74041 TCCAGTTTTT CAGAATGGCT TCTAAAGGTT CTGATTCAGA GCTCTTAGGC GAAATTGAAC
74101 AACCAAGTGT CAAAGTACAA CATTCAGGAA GTTAAAAACA TGACTGACAT ATATGTACTA
74161 TATATAGTGA GCTTGTGTAT GTGTCAATGA ATGATTTAAT TCATTAATGA AGGAGGAAGC
74221 AGAATCACAA TTAGGTCAAA GGAAGATACG GGAGAATAAA ATATGTATTT GGTCAGGGAA
74281 AGGATGTATA CTGGAAGAGG AAGGGAAAAT CAGATATAAA GTTGTTTAAT GACTTATTAG
74341 GCAATACAAT AATAACTTTT AGGGTCATTT TTTCTATATT AAGAATTCAT TTCCATCTCT
```

```
74401 ATGACAAAAT CCTTATTAAT TTATTAAACT TCTACAAGTG AATGTTTACT TTTAGATAGT
74461 CTGGACCCAA TAAAATGTAA ACATTAAGTC AGAGTTACTT TCACGTAGGA CAGTGTTGTC
74521 CAATAAGGTA CCACTAGCTA CACGTGATCA TTGACCATTT GGACTATAGC TAGACTGATT
74581 TAAAATGTTC TAAAAGTGTA AAATACACAC CAGGTTCTGA AGATTTATCA TTTAAAAAAG
74641 AATGTCAACT GTCTTTTTTT TTAGCTTATT TATTATATGT TGAAGTGATA ATAGTTTAGA
74701 TATATTAAGT TAAATAAAAT ATCTTAAAAT TAATTTTACT TGTTTCTTTT CATTCTTTCA
74761 ATGTGACCAC TAGAAATCTG GAAAGTATTT ATGTGATTCA CATTCTATTT TACTGTCTAG
74821 TATTGCCTTA CATCATCAGG TACCCCATAA GTAGGCTTTT TAGATAATTC TCTAATATAG
74881 CTTGGAAGGA TATGGAGAAA TATTTTTGCG TTGCTTTTAA GTTTTGCATA ACTTTTTCAA
74941 CACACTTTAT AAAGGATCTA GAAAAGGGTT GGTTACATGT TTCTCTGTCT TCTGGCCTCC
75001 ACCATGTTGC CAGGAGGTTG GGGACAAGAT TCTGGGTGGC TGGATGTCCT AATGGCTTGA
75061 GGTCTGGACT TGAGATTTGC ATATAAAGAG ATGTGATTAG ATTGAGTCGA CTAGAAAAAT
75121 CATATTAGAG AACTGAATCA CAGCGATTAA ATTTACATGT CGATTTATAA ACCAGGACAC
75181 CAATTTATAG TGAAAGAAGG TCCAGTTACC TGGTAATCAA GACGTTTCAT AGCTATTTTC
75241 ATGATGGATA TACTTAGCTG AGTTTTAAAT GAGAAGGGGG TTCATTGCAC ATAGAATAAG
75301 ATCTAAGTGA AATGTTTATT TTATTTTTTT TTTTTGACA TGGAGTCTTG CTCTGTTGCC
75361 CAGGCTGGAG TGCAATGAGG CAATCTCGGC TTCTGGAGTG CAATGAGGCA ATCTCGGCTT
75421 CTGGAGTGCA ACGAGGCAAT CTCGGCTCAC TGCAACCTCC ACCTCCCGGG TTCAAATGAT
75481 TCTCCTGCCT CAGTTTCCTG AGTAGCTGGG ATTAGAGTTG CCTGCCACCA CGCCAGGCTA
75541 ATTTTTGTAT TTTTTTTAGT AGAGATGGGG TTTCACCATG CTGGCCAGGC TGGTCTCGAA
75601 CTCCTGACCT CAGGCGATCT GCCCGCCTCA GCCTCCCAAA GTGCTAGGAT TACAGGCGTG
75661 AGCCACCAAG CCTGGCCTAA GTGACATGTT CTTATATTGT TCCTTTCTTT CTTTTTTTTT
75721 CGACTGAGTC TCACCCTGTT GCACAGGCTG GAGTGCAGTG GCGTCATTTC GGCTCATTGC
75781 AACCTCTGCT TCCCGGGTTC AAGCGATTCC CTTGCCTCAG CCTCCTGAGT GCCACCACCC
75841 CCAGCTAATT TTTGTACTTT TAGTAGAGAT GGTGTTTCAC CATGTCGGCT AGGCTGATCT
75901 CAAACTCCTG GCCTCAGGTG ATCCGCCCCC GAGTCTCCCA AAGTGCTAGG ATTACAGGCG
75961 TGGGCCACGG GGCCCAGCCT TATATTATTT CTTTTACTAC AATATATTAG TATGATGCAG
76021 GTGCTTCAAT TGTTTATACA CTTTCCATAA TTTTGTATAA TTCTTATACC CTGTCACTCT
76081 GAGGAATAGC CGGTCTAAGT GTTTTTCCAC CACTGCTAAT TCATCCATCA CTAATCTCAT
76141 TAGACTGTTA ATTCCCAGAG GACATAAGCA CACAAGCAGA CAATGTTTAC AAATGTTGGA
76201 CAAATGTTAT TTAATAAAAC AATGGGGTCA CCCTTAGTCT AAAAGATGTT TCACTTTTCA
76261 TTTGTCATTG AACTCTTATT TGTAGGTTCC CTTTTGACTT TCCCACAATC TAAGGCTGTT
76321 CTCTTTAACA CATATTTTCA TGAAAACATA TATTTGAGCA GAAATTGTTG GGGAGTTGTA
76381 ATATTACCTT TGTCCCTAAA TATGAATCTA TAATTATATC AAATATATGG GCAGACAATT
76441 TACTTTGCCT TTAATCTCAA GAAAAAAATA GCAATTACTT GGGGTCGGAG AGTAAAATAA
76501 GAAGTAGTGA ACCTTAAAGT AGCAAACTTT AGAACAGAAT AGTTTCAGAG GGGATGAGAA
76561 GAGGTGATTT TCAGCTCAT CAACAACAGA TCTTATAATA AATTACATGT TCTGGTACTT
76621 TTCTTGTCTT TCTGTGTTAA ATTTTGCTAT TTAAAAAAAT AAATTTCAAA TACATTGTTC
76681 ATCTTAAAAG TCAAGAGTGT GTTTTATTAA AGTCAGTTGC TTTATTTGCA ACTCAAAAGA
76741 TATATTTGAG TTCCCAACTG GAGATTGTCC TATATGGTAA CTTGCGTAAG GTATGGTTAC
76801 TGAAAGTAAC CTACAATTTT CATGGGCTGA AATTCATTTC TATATTGCAG CGTACAAAAA
76861 TAAATAAATA AAAAATGCTT GTTTTCTTTG AAAACATATT ATCTCAGTGC CTCTAACTGC
76921 CAAATCTATT GGCTTTTTTG CAGGCTTAAG GGCTCTCCCT TGTTCCTTTA TGATCTCTAT
76981 CTTGAGGGCC AGACCTCCTG CCTTACACAA CTCAGAGGGG GACCTCAGAG CTCTTTAAAA
77041 AGAGCCCAAT TTCTCGCCTG TAGAGAAGTG AAAAGGATGC CCCACCCCCA TCTATGAAAA
77101 GAGGGATTTG ATAGTTTCAA TGTCTTCAAA TCAAAGATTT AAGTCTGTAG CCCCCCACCA
77161 CCCCGGACCC TAGCAAGGCT CATGAACCCC CTCCCATCCC GCCCTAATTG CTTTGGACTG
77221 GCCGTGGAAT CCTTGTCCCA GTCCACAGTT CCTGTGCGAC TGCACGAAGA ATTCACAGAG
77281 GACCTGTGTT ACTTCCCTTG TGAAGAAACA GAATTATCAT GAAAATTTAG GTGGAAACCA
77341 TTTCGCTTTT TCTTCAAAA ATAAGGGAAG CATGTGCCCA ACCACCCCTG GAAAAAGAA
77401 CCTTCAGGGG CAAAGGAGCG AACAGGTAAT TTATAAGAAA AACAGAAAGT GGTCTCTGAC
77461 TGCCCCAGAC TTCCTTCGGA GTTGGGGGAA TTGGGGACGC CTGGACGCGT TGTTTTTGTG
77521 TTTGTGGAAA AAATAAATGA AGAGCATGAA GCCCGAGGCT TCTGAGATCC TTTCCTGACC
77581 AAACCCAAGT GATTTGGTGC GGGGAATTTT AATATTTTTC CCCTTTTGTG AGGTGGAACA
```

Figure 1 (Page 24 of 73)

```
77641 AACACAACTT GGGAGCAGCG CAGCGGCTCA GAGCCTGCCA GCCAGGCGGG CGACCAGAGC
77701 ACCAATCAGA GCGCGCCTGC GCTCTATATA TACAGCGGCC CTGCCCAGGC GCTGCTTCAT
77761 CGGCGCTTTG CCACTTGTAC CCGAGTTTTT GATTCTCAAC ATGTCCGAGA CTGCTCCTGC
77821 CGCTCCCGCT GCCGCGCCTC CTGCGGAGAA GGCCCCTGTA AGAAGAAGG CGGCCAAAAA
77881 GGCTGGGGGT ACGCCTCGTA AGGCGTCTGG TCCCCCGGTG TCAGAGCTCA TCACCAAGGC
77941 TGTGGCCGCC TCTAAAGAGC GTAGCGGAGT TTCTCTGGCT GCTCTGAAAA AAGCGTTGGC
78001 TGCCGCCGGC TATGATGTGG AGAAAAACAA CAGCCGTATC AAACTTGGTC TCAAGAGCCT
78061 GGTGAGCAAG GGCACTCTGG TGCAAACGAA AGGCACCGGT GCTTCTGGCT CCTTTAAACT
78121 CAACAAGAAG GCAGCCTCCG GGGAAGCCAA GCCCAAGGTT AAAAAGGCGG CGGAACCAA
78181 ACCTAAGAAG CCAGTTGGGG CAGCCAAGAA GCCCAAGAAG GCGGCTGGCG GCGCAACTCC
78241 GAAGAAGAGC GCTAAGAAAA CACCGAAGAA AGCGAAGAAG CCGGCCGCGG CCACTGTAAC
78301 CAAGAAAGTG GCTAAGAGCC CAAAGAAGGC CAAGGTTGCG AAGCCCAAGA AAGCTGCCAA
78361 AAGTGCTGCT AAGGCTGTGA AGCCCAAGGC CGCTAAGCCC AAGGTTGTCA AGCCTAAGAA
78421 GGCGGCGCCC AAGAAGAAAT AGGCGAACGC CTACTTCTAA AACCCAAAAG GCTCTTTTCA
78481 GAGCCACCAC TGATCTCAAT AAAAGAGCTG ATAATTTCT TTACTATCTG CCTTTTCTTG
78541 TTCTGCCCTG TTACTTAAGG TTAGTCGTAT GGGAGTTACT GAGGTATCAG ACGAATTGGG
78601 TGACGGGGTT GGAGAGTGGC CGTGGTGAGG TTACAGCATT TAAACCTTTA TTGCGGCTTC
78661 TAGGTCCCTG ACCGGAGGCT TTTCTCGCTG GCGGATGGTT TTGGGATGGC AGTCCCGCCC
78721 CAGGCCTGTG AACGGCAGAA AAGACCGCAA AACAAGAGCC AGTTTCTTAG TCTAAAGGGA
78781 TGTCCGGATT GGACTAAAAA ATTTTCAAAA GTCCCGCCCT GCTCCGGGT TGGTCCGTTC
78841 TTCTAGTACA TGACTTTCAT TCTGTATTTA ATTGGATGGT GGAAGACGTT GCTTATTCTG
78901 TGTTTTTTGC TTTACTGTGA CTTAAAAGTT TTGCCTCTTT TCTCTTTATA TTAATGTCTG
78961 GGATTTCGGA CGCTTTCCAT GTTGTTGGTA GTCAAGTTGA TGTCTCCTGG AGGTAGTGGC
79021 AACATCCAGC CCTGGGAGGA GAGTGCGTGC AGGTACCTTT GTCCTACATT CCTCTGCTGT
79081 TAATTTCTCA TTCCTGTGGC AACGAAGGAA TGCATTTAAA AAACAGCCAC AACAGCGGCA
79141 ATAGCCCTTC CTCCACCCAA GGCAATCGTG GACCTAGGGA GTTTTTGTG CCACATAACA
79201 TGTAGCCTTC CGCTAAACTG ACAGGTTTGA GCGTATCGAT TTTGAGCGTA TCGAAAGCAC
79261 AACTTTTAGC CAGCCATTTT GTCCTCGCAT GACTACGGTT GCTTATCCTG TTTAGACAGA
79321 CAGCAACATT TAAAAATCGA AGTTCCTTTA AACGTATTTT GTTTGGCAGT CCAAATGTTT
79381 CTATGCAGAA AACAGTATTT GTACTATTAA CTATGAAGAG TGTATGGATA AATGGGAGAC
79441 ATTTCTAATA AAGGCCTTCG TTAATGGTTC CCTCTGTTTG ACATCCATGG TGCTTCTGAA
79501 TACAGAAAGC CTAGCGTCTT ATATTCGCTT CTTTTAAAAT CTGGTGGGCA CATTTGGTG
79561 AGACCTAAAT TATGGGGACT GGGGCTTCTG GAGATAAGCT GCTCAATTAT TCTACCATCT
79621 CCACAATGAT TAATATAGTG AGTTGATTTG TTAGTGATAG TGACCACGGA TTCATCCCAA
79681 GAAAGAGAAA GGGGAGGGAG GCAAGCAGAG AGACAGGAAG ACAGAGGCAG GGAAGAAGGA
79741 GAAAACATTC TCCCATGGTT TAAGTAATTT TGTGTTGTTA ATTTTACATT ACAACACGGT
79801 TTAACATGGT GAACCCTCTA TTTTGGTGTA AGGTTTAACA TATGGACATA TTTTTCCCAA
79861 GACCATTTAT GAACTTTCAT TTCTGCTTCC CCCTTCTTCC TCCCGTGCCA CCCTCCACGC
79921 TCCTATCAAT TTTGGCTGTT TTGTCATAGG CTAATACGCT ATAATTTCAT GGACAGTTGG
79981 ACTGTCTTAG GTTTCTCAGG TTTCTATTTT GTTCCTTTAG TCATTCCCAC AATTCTTAAG
80041 GTAGAATTGT ATTGTTTTAA ACATTGTGTT GTGTGCTATC CTCAATGCTG AGATGATTAT
80101 GTGACAAATG GCAAGTGTTC AACTAATACC TAAATCTGTA GTATCTTATC AAGCCTAATG
80161 CTACTTCACA ATGCCTACTC CATTCACCTC ACTTTATCTC ATTACTGGCA TTCTGTCATC
80221 TCACATCATC ACAAGTAAAA CGGTAAGCTA TTTTGAGAGA GATCACAGTC ATATAATTTA
80281 TATTTATATT TATTTATTTA TTTATGAGAC GGAGTTTCCC TCTGTCACCC AGGCTGGAGT
80341 GCTGTGGCAC GTTCTCGGCT CACTGCAACC TCCGCCTCAC GGGTTCAAGC GATTCTCCTG
80401 CCTCCGCCTC CCGAGTAGCT GAGATTACAG GGCCTGCCA CCATGCCCGG CTAATTTTTG
80461 TATTTTTAGT AGAGACGGGG TTTCACTAAG TTGGCCAGGC TGGTCTCGAA CTCCTGACCT
80521 CAGGTTATCC GCCCACCTCA TCCTGCCAAA GTGCTTAGAT TACAGGCGTG AACCACCGTT
80581 CACAGACTCA AATCATTTTT ATTACAGTAT ATTGTTATAA TTGTTGTTTT ATTATCAGTT
80641 ATTGCTAATC TCTTACAGTG CCTGATTTAT AAATTAAATT CATCATTGCC ATGTGTATAT
80701 AGAAAAAAAC AGTGTATATA CGGTTCAGTA CTATCTGTGG TTTCAGGCAT CCACTGGGGG
80761 TGCAGTTTAT TAAACATGCA TTTACATTAG TCTCCCCTTT GGGAGACTAA TTAACTGAGA
80821 TGTTGTAACG TGACTTTAAT AGCAGATAGA GCTAATTTTC TCTCATTACT CTTCTTTTTC
```

```
80881 AGAATTTTCC TGGTTATTCC ATTTTTTATT TTTCCATATG TATATTAAGA TCTCTTCCAC
80941 CTCCTCCTGT TTCTCCATCT CAACATCAAA CAATTAAAAA AAAAAAAAAG GCTGGGCGCG
81001 GTGGCTCACG CCTATAATCC CAGCTCTTTG GGAGGCCTAG GCGGGTGGAT CACGAGGTCA
81061 GGAGTTCAAG ACCAGCCTCG CCAAGATGGT GAAATCCCGT CTCTACTAAA AGTATAAAAA
81121 TTAGCCAACC ATGGTGGCAG GCGCCTGTAA TCCCGGCTAC TCGGGAGGCT GAGGCAGAGA
81181 ATTGCTTGAA CCTGGGAGGC GGAGGTTGCA GTGAGGCGAG ACCTTGCACT CCAGCCTGGG
81241 TGACACAGCG AGACTCCGTC ATAAAAAAAA AAAGCCGGAA GCAGTGGCTC ACGCCTGTAA
81301 TTCCAGCACT TTGGGAGGCT GAGTCAGGCA GATTACCTGA GGTCAGGAGT TCAGGACCAG
81361 CCTGGCCATG AAAATACAGC CTGGCCATGA AAACACACAA TAAATTAGCT GGGCGTGGTG
81421 TCACACACCT GTAATCCTAG CTACTCGGGA GGCTGAGACA GGAGAATCAC TTGAACCCAG
81481 GAGGCAGAGG TTGCAGTGAG TTAAGATGAC GCCACTGCAC TCCATCTGGG CGACAGAGCC
81541 AGACTCTCTC TCAAAAAACT AAATAAATAA AAATAAAGTT ATGGTACATT GAACTTCTGT
81601 GTTCCTTTCT CCCTTAGATA CTTTCATGGC TACCCATTTA ATTGATGTTC TTATCATCTC
81661 CAAGAGTTAG TCAGGAGAGG AATCAACCCA AGCAAAAATA GCTGATTTTC TAATTTTCCT
81721 TCAATGCCCT TTGGGGTCTT AATCCATTTG ATTTATGTAC TTTCAATTAA TCCTAACCTC
81781 GAATGTCTTC TGCAAACATG TTTCCACAGA TGAAACTCGT CAAATGAAAC ACATTCCTTT
81841 AATTTATAGA GTTAAAAATT AGAAAATTT TCAATTCTAT TTGGCCTTTA GATTCAGTCT
81901 TGCATATGTT TTCTCAATTT TGTTCATGCT CTTTAGTTTT GTTTTATTCC ATCACAATTG
81961 TTCACATAGC TTACTGGCTT AGGTCTAATG AACCATTCAT TTGGAAATTA AAATTGGCCA
82021 TTTTAAGATG AAAAAGATTC TTGCCTCAAT TTTACTTAGT TTTTGAAACT GTCAATGAGG
82081 ACACATGTTT TTCTGTACTC TTAGATTCAC TAAGTAGTGT CTTGCAAATT TAACTGACAA
82141 AGGACAGATT AACATGCGAA AAAAAGAGCA TGCAATTTTA TTAGTATATT ACATGCACAG
82201 AGTTCCCAAA GAAAAAAAAA TTGAAACCTT AAAAACGCGG TTAGACTCAC AGACTTATAC
82261 ACCATTCCAA CAAAGGAAAG GGAGTTTGCA CTTCATGGGA TGACGAATTT GGGAATGTGA
82321 CAAGGAAATA AATACATGGG CAATAAAAAC CATGGAAGAT AAAATGAAAG ATAGAAATAA
82381 TTGTAGTAAG GTTTGTTTTT GCAGAGTCAT CTCAGTGCCA ACCTTCCATA TCTAGTGATA
82441 AGAATTGCTC TCTTTTTCCT GGTATAGCAG TTGGGGACAC TTTTACAAGG GAAATTTCTG
82501 TCACCTTCAC AAAGGGAAAT TTGGGTAAAG AGAAGACAGA GACCTCTTCC TACACCTGTT
82561 GATTTTCAAT TGCCTTCAGC TGAAAATAAC TTTTATGCCA AGTAGAATA ATTTGGGGGT
82621 GACATCCTGA TATTCTTCAA AACTTATATT TAATTTCACA TTAGTAATTA TATCATTTTT
82681 GATTTTTAAA TTAGTTTTAT AAAATAATTT TGAAAACGG TAATAATATT CAAATAATTC
82741 CAGAAACACT GCTGATAAGC CAAAAACATC AATGAATATT GCATAAACAA CTGATAATTC
82801 AACCATGAAA ATTTATGACA TTGTTCTTGT GTGATAAAAC TATGAGTAAC ATAAAAACTA
82861 GAGGCTACTT GTAATGCATT ATTCCAAACT TTCTGTTTTT TATTTATTTA TTTATTTATT
82921 TTGAGACATA GTCTCTCTCT GTCACCCAGG TTGGAGTGCA ATGGCGTGAT CTTGGTTCAC
82981 TGCAGCCTCC ACTTCCCCGG TTCAAGCAAT TCTCCTGCCT CAGCCTCCTG AGTAACTGGG
83041 ATTACAGGCA CCTGACACCA AACCCGGCTA ATTTTTTGT ATTTTTAGTA GAGACGGGGT
83101 TTCGCCATGT TTGCCAGGCT AGTCTCGAAC TCCTGACCTC AGTGATCCAC CTACCTCGGC
83161 CTCCCAAAGT GCTAGGATTA CAGGCGTGAG CCACCATGCC CGGCGCATTA TTCCAAACTT
83221 TCATACACAG TGCTATCATG GCTACAAATT GAAGTATCAT ATTATACACT CCTAGGCAAA
83281 GCTCTGGATA TTTTGGCTAT ATAAGCCTGA GGGAAATGTA GTAAGGACAT TGTGGTTGAA
83341 ATTCATACCA GAGATGAACA GGCCCAGTGC AAGACAGAAT TACATCACTA AAGGATATCA
83401 GAAGAGAATA GGGATTTAGG GTACAGTGGC AACAACAGTT TTGGGAACTA GCATTTTTTG
83461 AGCACTTATT TACAATATGC CAAGCACTGT TGCTGATTAC TCTATATTTA TTTTCAAACA
83521 CATTCTTGTC ACAGCACTTT GAAGTAAGTG CCATTGTCAT TCCCACTTCA GGGTGAAGGA
83581 CTAAAGCTTG GTGTCATTAA GGATGTAGCT AGTTAGCTGT GTGTGTGTGT GTGTGTGTGT
83641 GTGCATTTTT TTTTAAATTT AAAGTCAATA AATTTTTATT TGAAGAATTT CACATCAAGG
83701 TAAACTTTGT TCCTCTAAAG AGCTGGAGTC AAAATGTATC TTCAAAAGAT TCATCTTCAA
83761 GTTAGCCCTT CTTAATAGAA CTGATGCTTA ATCCACAGTT GTCAGCCCAC AGTTCTTTTA
83821 TTTTGACTTT TTTTTTTTTT TTTTTTGAG ACGGAGTCTC TCACTGTCAC CCAGGCTGCT
83881 GGGCAGTGGC GTGATCTCGG CTCGCTGCAA CCTCTGCCTC CCGGGTTCAA GTGATTCTCC
83941 TGCCTCAGCC TCCTTAGTAG CTGGGACCAC AGGCGCATGC CATCGTGCTC GGCTAATTTT
84001 TGTATTTTTA TTAGAGACAG GGTTTCACTA TGTTGGCCAG GCTGATCTCA AACTCCTGAC
84061 CTCATGATCC GCCTGCCTTG GCCTCTCAAA GTGCTGGGAT TACAGGTGTG AGCCACTGCA
```

```
84121  CCCGGCCTTA  TTTTGCCTTC  TTTAATCTCC  ATTTGAACAT  ACACATACTG  ATGAAAACTA
84181  CAACATTCTT  CACCAAAAAT  CTTTGGGATT  TAATTTCTTC  AACCACTTTA  CTTTGGGGTC
84241  ATTTTAAGAT  TAGGTGTATC  TGCCTGGTTC  TCAATTTGAC  ACCCTTTCTC  TCTAAACATG
84301  AATGAGTTCC  AATCATATTT  ATTCCTAAGC  TATCACACTC  AAATATACTA  CAGATCTGTG
84361  GAATATGCCA  AAAGTTAAGG  TGAAAAATTA  AATTATTAGG  TATTTCATAG  TTTTGCTAGT
84421  TTTTGATCTG  TGAGTGAATA  TAACTATCCT  CTATGTCCTG  GCACTGTTCC  TCAGAAACAT
84481  AGGGTCCACA  TATGTAATTT  TAAATTTTTT  AATAGGCACA  TTTTAAAAAG  TGAAAAAAGA
84541  AATCTATTTT  AATGATTTGA  ATCCAGTGTA  ACCAAAAATT  GTTTCAACAA  GGTATCTAAT
84601  ATTAAAATAT  TGAGTTTTTA  CTTTGTTATT  TTACTAGTTC  TTTGAAATCT  GGTGTGTATT
84661  TTACACTTAA  AGCACATCAC  AGTTTGGAGT  AGCCACATTT  CCAATGCTTA  ATACTCACAT
84721  ATGGTTAGTG  GCAACTATCT  TGGACAGGAC  AGCTTTTATA  CTCTGGGAAG  ACACAAGCAA
84781  ATACTTGCTC  TGCAGCAGAA  TCCAGATGTT  TTCCAAGAAA  ACACTTTTTC  TGACCTGTTC
84841  CTGAAACCCA  GGTAGTGTCT  CTAATACTTT  ATATTTTATT  GGTTTGTCCT  ATTGTAACCA
84901  CCCAACGGGC  TCTCCTTGTC  CACTTCCTAG  ACAGAGCTGA  TTTATCAAGA  CAGGGGAATT
84961  GCAATAAGGA  GCCAGCGCTA  CAGGAGACTA  GAGTTTTATT  ATTACTCAAA  TCAGTCTCCT
85021  TGAGAATTTG  GGGACCAAAG  TTTTTAAGGA  TAATTTGATT  GTAGGGGACC  AGTGAGTCGG
85081  GAGTGCTGCT  TGGTTGGGTC  AGAGATGAAA  TTATAGGGAG  CCTAAGCTGT  CCTCTTGTGC
85141  TAAATCAGTT  CCTGGGAGTG  GTGGGGTGGG  GGACTCAAGA  CCAGATAATC  CAGTTTATCT
85201  ATATGGGTGG  TGCCAGCTAA  TCCATTGTGT  TCAGGGTCTG  CAAAATAGCT  CAAGCATTGA
85261  TCTTAGGTTT  TAAAATAGTG  ATTTTATCCC  CAGGAGCAAT  TTGAGGTTTA  GAATCTTGTA
85321  GCTTCCAGCT  GCATGACTCC  TAAACCATAA  TTTATAATCT  TGTGGCTAAT  TTGTTAGTCC
85381  TGCAAAAGCA  GTCTGGTCCC  CAGGCAGGAA  AGGGGTTTGT  TTCTGAAAGG  GCTGTTATTG
85441  TTTTTGTTTA  AAAGCAAAAG  TATAAACTAA  GCTCCTCCCA  AAGTTAGTTA  ATCCCAAACT
85501  CAGGAATGAA  AAGGACAGCT  TGGAGTTTAG  ACGTTAGATG  GAGTCGGTTA  GGTAAGATCT
85561  CTTTCACTGT  AATAATTTTC  TCAGTTATGA  TTTTTGCAAA  GGCAGTTTCA  CTGTCCACTT
85621  CACCTCACAT  CAGGCCTCTG  ACTAGAGGAT  TCCAACAATA  CTTAGGCCAG  GACACCACCA
85681  TGTCTCCTTA  TCCACCCTGA  GGGAGTCCAA  TTTCTGAAAC  AAAGGAAACT  ATATATGATA
85741  GTATGAAACT  ATATATGAGA  AGGAAATTAT  ATATGATAAT  CAATTTTAGG  GTTATCTTAT
85801  TGATTAGAAG  ATATTAAAGT  GTGACACTGC  CTGGCAATGA  TATCTGCTGG  TAGTAAGAAT
85861  TTGGCGAATT  TAGTGAAATT  CCTGAGGCTG  AACCTCCACT  TCTGTAAAAT  GGAGACAGTG
85921  AGATAATTTG  CCTTACAATG  CTGAAGTAAG  AATTTTACAC  AATAATTCAG  ACCAACCACT
85981  TCATGTGGTA  CTTGGCCCGT  GGAAGACTAT  CAATGACAGT  TAGTTTATAG  TTTATACTAT
86041  TAATGAATCC  TTTGTTTCAT  TGTTATTTCC  TTCTACACGT  TGGCCTCTCT  AAAAGAAGGT
86101  AATATTCAAT  ACAAATAAAG  TTAAAACAGC  TTGCAGAGTT  GTCCCAGGGA  ACTCACTTAA
86161  CCACTGAAGT  GTTCAAATTG  CTTAAGGTTG  ACTTTATATT  CTCCTGACTA  ACCTTTCTCC
86221  TTCTGGTATT  TCTTCTGAGA  ACAGCACCAC  CATCCAAAGC  ATCATGCAAA  CAGTGGTCAT
86281  CCCAGACCAG  TAATTCTCAA  CTCACAGGGT  GCTCCTGCAG  AGATGTATTT  GAATAGAGTG
86341  GTAGGATGCT  GAAGAAGGCC  ACGTAAAATT  TGGCCAGTGA  TCTGGGGCAG  ATTTATCCTG
86401  AAGCTAATGA  AACACAAGTG  TAAGGGCCTG  TACTTCCAAG  GTGCAGAGAG  GGGCCCTACA
86461  AATGTGTTAG  TTTGTCTCTC  TCTCTCTCTC  TGATTTTAAA  ATTTGCAGTA  TTAAGGTACT
86521  TTAATCACGG  ATGGTTCAGG  CTGCTATTTT  CACTCAATCC  TCCTTTTTAT  TAAAATCACC
86581  ATTGTCTGAT  TATGTTAGAA  TCCTGATGAA  AATATTTGGA  ATTTGAGTAA  GAGAAAGTTT
86641  AGTTGAAGAT  GTATCTAGTA  TGGGGATAAT  AAGTTACGTG  ATTTGCATAT  GTGATCATGT
86701  GTACTTCATT  CGTTGCCAGC  CAATCTGACG  TAAGAATGGC  TTCAAGGAGG  CCGGGCGCGG
86761  TGGCTCACGC  CTGTAATCCT  AGCACTTTGG  GAGGCCGAGA  CGGGCGGATC  ACGAGGTCAG
86821  GAGATCGAGA  CCATCTTGGC  TAACACGGTG  AAACCCCGTT  TCTACTAAAA  ATACAAAAAA
86881  TTAGCCGGGC  GTGTTGGCGG  GCGCCTGTAG  TCCCAGCTAC  TTGGGAGGCT  GAGGCAGGAG
86941  AATGGCATGA  ACCTGGGAGG  CGGAGCTTGC  AGTGAGCCGA  GATTGCGCCA  CTGCACTCCA
87001  ACCTGGGAGA  CACAGCGAGA  CTCCGTCTCA  AAAAAAAAAA  AAAAAGAATG  GCTTCAAGGA
87061  ATGTTCCTAC  TGCTCACTGG  AATAACTCAC  CTAAATTCCT  GGCAAGATGC  AGGTCTAGAT
87121  AAAATGTTAT  GACATCTAAG  TATTCAAAAC  ACATTCCAG  CACTGAGAGT  GAGTGTCTAG
87181  TGGAGAGTAG  AAACGTATAG  AGCCAGAAGC  TAGTCTGGAA  AGAATTCTTA  CAAAGTTTAC
87241  AACTTACATG  TGAAAGGAGC  TTAACAGAGG  ATTTTCCAAA  TTTGAAAACA  ATCCTAAAAA
87301  CTTACTTGAC  ATTACCAATA  ATGTGTTTTG  AAACTGAAAT  ACTTCTAAGT  TATGAAGAAA
```

Figure 1 (Page 27 of 73)

```
87361 ACATATTATC ATCAGCCACC CTGGAGGAAA GATTGAATTC TATTTCCATT ACCTATAGAC
87421 AACATTACAA AATAATTTCG ATCTGAAGAT GGAATCAGAG TATTCAGTCA AAACTACAGG
87481 AAAATATACT TGGTAGTGTC ATATTCAGAA GTTAATAAAA TATGCTATTT TCTGAATTTT
87541 GTGATGGCTG TTGTTTTGTC AGCTTTTATA AAATTGGAAT TTGATTTTAT TTTCCCATTA
87601 TAAATTTATA TTTACAGTCT GCAGTACTTT TGCATTTTTA ATTTTACATT ATAGTTTTTA
87661 ATAGTTAACA AGTTGTAAAA GGTTTGATCC CCAGAAAACC TTGATCTACC CCATCAGTTA
87721 AGTATACTAA TATATTTAGA AAATGGATGA AATCAGCATT TGAATATTTT TAAATATTTA
87781 TTAAAAGAGG ACATGGGTAA AAGAGCTTTG CAGTTGCCAC CCTTCATTCT CAAATTCCCT
87841 GGATAAGGAT GACCGCATAA TCTTTGGATG GTCATACGCA AGTCTTGTGT ACTTGTTACA
87901 TAAATCTATT TAGTGGACTT TTGGCAGTGT GTACTGAGGC CAGTTTCTTC CACCTGAGCT
87961 CTGACTCCAC CTCCAGCAGC CCAAAACCAA TACTGAATTT TGGGGTCAGC TATTGTTTTT
88021 GTGGACTTAG GTAACTACAC ACACATTGTC TTTATGATAG CTTTAATAAT ACTGCCATCA
88081 GAACTAAAAT TGTCACGTGG ATTAAAAGGA GTGACGGTGG TGTCCCCAGG AGCCTTTCAA
88141 TATGTAAGTA TTTACACATA TACATGCTAA AAAGACCCCT AGGAATTTTT TAACAAGGGC
88201 AAAACAGTAA CTCAGCTTGT TTTCTCGCAG TAAAACCGGT TGAAAAGGCC TGATAGACTT
88261 GTCTGCAGTT ACAAAACTTG TGTGTAGTTA TCACCTTTAT ATCTCCTGGA AACTAACATA
88321 GACAACCGAA TGGGTTACAA CTGTTTTTAA GTGAAATTGT GAGTGGCTCT GAAAAGAGCC
88381 TTTTCAATGA GGAAGAAACG GGCAGACTTA TGCCCTTTCC CCACGGATGC GACGTGCCAG
88441 CTGGATATCT TTGGGCATGA TGGTGACGCG TTTAGCGTGA ATAGCGCACA GATTGGTGTC
88501 TTCGAAGAGT CCCACCAGGT AGGCCTCACA AGCCTCCTGC AGCGCCATCA CCGCAGAGCT
88561 CTGGAAACGC AGGTCGGTTT TGAAGTCCTG GGCGATTTCT CGCACCAGGC GCTGGAACGG
88621 CAGCTTCCGG ATCAGCAGCT CGGTGGACTT CTGGTAGCGA CGGATTTCGC GCAAGGCCAC
88681 GGTGCCCGGG CGGTAGCGAT GAGGTTTCTT CACGCCACCG GTGGCCGGAG CGCTCTTACG
88741 GGCTGCTTTA GTAGCAAGCT GCTTGCGCGG AGCTTTGCCG CCGGTAGACT TGCGAGCTGT
88801 TTGCTTCGTA CGAGCCATTT GCAATGAGAG CACACACAAA AGTGTAGTGA ACTGAGAGCA
88861 AGTGGCCTTT AAATATAGTG AGAAACATTC TGATTGGTCC TGTAATATTT CAAAAGTCCC
88921 GCGCGATAAA ATCATTGGCT GAAGAGTGAC CAGACTGATT GGTTCATTAC TAGACAATCT
88981 TATTGGATGA GTTGCCCCAC CGCCCATCCT GTCCTTTTCG TTTCAGTTAT CTGCAGCGAC
89041 AAATTGTCTA AAATTCTAGT TCATCCAGTC CCAAAGAACA GAGTGTATAA CAAGGTATCT
89101 AAGGATTTTT AAAATGTAAA TTCCGATTCA GTAAGTTTGA GTGGGACTTG AAATTCTGCA
89161 TTCCTGACAG TCTCGCAAGT TATCAATGCT GGTGAACACT CACTAAACCA CCAGAAACGT
89221 TCAGACTCAT GTCGGGAAAT AACGCTTATA TTCAGAGAAT GAGATTCCAT GCTATTTTGT
89281 TACTGGCGAA CAGCAAGTTT CCTTGCCCTT TGTTTTCTAA GTCCAAGTCA CATTCCCACC
89341 CTGCCTGTTC TCAAAATGTC TTATTTTGGT TGGCCTTAAG TTTCACTTTG TATACTCTAA
89401 AATGTACTTT CTAAAGGAAG GTGTTATTTT CTCGAAACTT AACTTTTTAA CACCATTAGG
89461 CTAGGGGGGC GGTGGCTCAC GCCTGTAATC CCAGCATTTT GGGAGGGCGA GATGGGACGA
89521 TCACTAGAGG CCAGGAGTTC AAGACAACCC TGGCTAAAAT GGTGAAACCC CGTCTCGCAT
89581 AAAAATACAA AAACTAGCTG GGCGCGGTAG CAGACGCCTG TAATCCCAAG TACACAGGAG
89641 GCTGAGGCAT GAGAACCGCG TGAAGCGGCG GGTGGAGGT TGCAGTAAGC CGATATCGCG
89701 CCGCTGCACT CCAGCCTGGG TGACAGAACT AGACTGTCTC AAAACAAACC AATCCAAACG
89761 AAAAGCAAAA AATACCCTAA CAGAAGCAAG TTATCATCCT TTCTTGTGTA ACTATGGACG
89821 GCTCTGAAAA ATGCCGTTTC AAGTGTAAGC TACGTTTTCT GATTTGAGTG TTTACTTGAC
89881 CTTGGCCTTA TCGTGGCTCT GTTATTTTGG CAACAGGACG GCCTGAATAT TGGACAGGAC
89941 GCCTCCCTGA GCAATAGTGA CGTTGCCCAG CTGCTTGTTG ACCTCCTCGT CGTTTCGGAT
90001 GGCCAGCTGC AGGTGGCGGG GGATGATGCT GCGGGTCTTG TCACGTATGG CGCTGCCCAC
90061 CAGTTCTAAG ATCTCGGCGG CCAGGTATTG TAAGTACACT GGCGCACCGG CTCCGACCGG
90121 CTCAAAATAA TTGCCCTTTC GAAAAGATG ACGGACTCTG CCCTATTGGG AACTGCAAGC
90181 CCGGTAGCGA CGAACAAGTT TTTGCTTTAG CTCCATTTTC CACGTCCGCA AATAGCGACC
90241 TATGAAAGCA GCGGAAAACT GTGAAAGACA AGCAAGCTGG AATGGCGCCT GAACAAATCC
90301 TTTTATACAA ACTGCAAGGC TGCAATAGGA AGCTATCCTA TTGGTCAATT ATGTTTGGTG
90361 CTTTATCCAA TAGAAAAAGA TAACATAAAT TCCATATTTG CATAAACCCC ACCCCTCAGT
90421 GAAACCGTGT TTCTTTTGTC CAATCAGAAG TGAGGAATCT TAAACCGTCA TTTGAATCTC
90481 AGGACTATAA ATACATGGGC TCTGAACTGT TCTCTGTACT ACTCTGTAGT GGAGAGTGTT
90541 AGTAGCTTTT CTATTCTGTT TAGGAATAGC AATGCCTGAA CCCTCTAAGT CTGCTCCAGC
```

Figure 1

```
90601 CCCTAAAAAG GGTTCTAAGA AGGCTATCAC TAAGGCGCAG AAGAAGGATG GTAAGAAGCG
90661 TAAGCGCAGC CGCAAGGAGA GCTATTCTAT CTATGTGTAC AAGGTTCTGA AGCAGGTCCA
90721 CCCCGACACC GGCATCTCAT CCAAGGCCAT GGGGATCATG AATTCCTTCG TCAACGACAT
90781 CTTCGAGCGC ATCGCGGGCG AGGCTTCTCG CCTGGCTCAC TACAATAAGC GCTCGACCAT
90841 CACCTCCAGG GAGATTCAGA CGGCTGTGCG CCTGCTGCTG CCTGGGGAGC TGGCTAAGCA
90901 TGCTGTGTCC GAGGGCACTA AGGCAGTTAC CAAGTACACT AGCTCTAAAT AAGTGCTTAT
90961 GTAAGCACTT CCAAACCCAA AGGCTCTTTT CAGAGCCACC TACTTTGTCA CAAGGAGAGC
91021 TATAACCACA ATTTCTTAAG GTGGTGCTGC TGCTATTCTG TTTCAGTTCT AGAGGATCAA
91081 CTGGAATGTT AGCGAAGACA AGTTTTAGAG CCAAGGTTAA CTTGGACGGG GCCGTGCGCG
91141 GTGCCTCTTG CCTTTAATCC CGGCAATTTG GGAGGCCGAG GCGGGCGGAT CACGAGGTCA
91201 GGAGATGGAG ACCATCCTGC TTAACACGAT GAAACCCCGT CTCTACTAAA AATACAAAAT
91261 AATTAGCTGG GCGTGATGGT GGGCGCCTGT AGTCCAGCT ACTCGGGAGG CTGAGGCAGG
91321 AGAATGGCGT GAACGCGGGA GGCGGAGCTT GCAGTGAGCC GAGATCGCGC CATGGCACTC
91381 CAGCCTGGGT GACAGAGCGA GACTCCGTCT CAAAAAAAAA AAAAAAAAA AATTAAAAAA
91441 ATATGAAGTT TGAAGCAGA AATTATTTTG TCGTATGTTC TTTCATAAAT TTTTTGCCTG
91501 CCTGCCTTCT TCCTTTGTTA CAGAACTCCA ACACTTACCC AAAGGTAGCT GTTGGGTCAG
91561 GGTTTCTGTA CTATAGTCCC TTCTGTGGTG GCCAGAAATA TGTTACAGGA AAGAGGTCCC
91621 CATCCAGACC CCAAGAGAGG GTTCTTGGAT CCCGCGCAAG AAAGAGTTCA GGGTGAGTCC
91681 GCAGTGCAAA GTAAATGCAA GTTACTAAG AAAGTAAAGT GGTGAAACGA CAACTACTCC
91741 ATAGACGGAG CAGGACATTC CCGAAAGTAA GAGGAGGAAG GCATCACCC TAGGTACAAT
91801 ACTTGTATAT ATGGGGAGAT GTGCTCTGCT ACAAGTTTGT GATAAAGGAT TAATTTTCTT
91861 AGTTACTATA TTTTGCAAGA ATCAACATTA TTATCTTTAA ACAAAATTAA GAATGCCTTT
91921 GTTCTCCAGA TATAGGGATA TCTGGACACT CCTAAGTCTG AGTCTGTTTA GTAAACATTA
91981 TTTATTTGTT CCCTTAACCG TAAACATCTA GAAGCTAGGA ATGACTGACT TTCTGGGAAT
92041 GCAGCCCAGA AAGTCTCAGC CTCATTTCC TAGCCCTCAC TCAAAATGGA GTTACTCTGG
92101 TTCAAGTAAC TCTGACACTT TTCTTCTCTT TTTTCTTCT TTTTTCCTTC CTTTATTTT
92161 TATTTTTTAT TTTGAAATA AGAAATCAAG AATACTTGAT GTTTCATCTA AAACAATACC
92221 CATAATTGAT AAGCCAAAAC AAAAACCTAG GTCTTCTAAC TCAAAACTAG GATGTTTTGC
92281 TGTCTCTGCT GATACTCGGC TGATCGTTAA TAGGTAATTA ACAAACAAGC CTTGCTATGT
92341 CCCCCTCAGT TTATTACCAT TAGATCATAT GCCTACTGTC AATCATATTA ATCCACAACT
92401 ATGCATTTCA CAAAACTTGC CATAAAAATT CACAGGTTTC CCGCTTCCCT CGAGTTTTCA
92461 TTTCCAAGG GTCCCATGTA ATATAAAACT TATATTAAAT ACATTTGTAT GCTTTTCTCT
92521 TGCTAATCTT TTTTTTTGTT TTTTGAGACT GAGCCTTGCT CTGTCACCCA GGCTGGAGTG
92581 CAATGGCGCG ATCTCGGCTC ACTGCAACCT CCGCTTCCCA GGTTCAAGCG ATTCTACTGC
92641 CTCGCCCTCC CGAGTAGCTG GGACCACAGA TACGTGCCAC CATGCCCCGC TAATTTTTGT
92701 ATTTTTAGTA GAGACAGGGT TTCACCGTGT TGGCCAGGAT GTTCTCAATC TCCTTACCTC
92761 GTGATCCGCC CGCCTCGTCC TGCCAAAGTG CTCGGATTAC AGACGTGAGC CACTGCACCC
92821 GACCAATCTG TCTTTTTGTA GAGGGGCCTC AAGCATGAAC TTACTGATGG GTGAGAAAAA
92881 CAGAATTTTC TTTTCCCCTA CAATATAAAC ATTAATTGTA ATGTTATCAT TCAGGACATT
92941 TTGGTGACCA ATCTTACAGA AATTTTATCT TGTGCAAGTC TATGCAAACC AATATGTAAA
93001 TCTTCTATAA GTGAGATTGT ATTTCACTTT TCTAGTATCC TTTTAAATTA ATAAAAGAGA
93061 TTCTAATGAT TATTTTCATT ACTGCATTTC ATTGTAGGGA AGTAGATAAT TGCCCTTTAT
93121 TCACTGACCT TCGCTTTTTA AAAATTTAAA CCATGTTACC ATGAAAATGC TTTTCAGTAT
93181 TTCTCTACAC ACAAGATTGC TGTAAGGGCA AAAATAGAGA TAGGAATCAT GCATCCATTG
93241 ATATACATAT TTTGATTTTT AATACATGTT ACCAAGTTGC CTCCTGAAGG TCTGTTTACA
93301 CTCTCACCAA CAGGGTGTTT TTTCCTGACT TCCACAAATG CTCTTGAACA GTGGGTGTGT
93361 TAGTCTGTTC AAATTGCCGA CATGAACAAT TAAATCTCAT TGTTGTTTTT ATTTTAAGA
93421 CAATTATTGT TTGAGACTGC ACATTTGAT AATAACATTT CTTCTATTAT GGTTTGATTA
93481 CTCATGATTC TTGCCCATTT TCTTTTGGGA TGTTGCCTTA TGTACATTAT TTTAAATAGA
93541 TAGCTCCATG TATTAAAAGA TTATTAAGTT TGAGGGCTTA TGATATGTCA GTTACATTTC
93601 TAAGATTTTT TTTTTTTTT TTTTGAGAC GGAGTTTCAC ACTTGTTGCC CAGGCTGGAG
93661 TGCAATGGTG CGATCTCGGC TCACCGCAAC CTCCGCCTCC AGGGTTCAAG CAATTCTCCT
93721 GCCTCAGCCT CCCCAGTAAT TGGGACTACT GGCAAGCGCC ACCACGCCTG GCTAATTTTG
93781 TATTTTTATT AGAGATGAGG TTTCTCCATG TTGGTCAGAC TGGTCTCGAA CTGCCGACCT
```

```
93841 CAGGTGATCC ACCCGCCTCG GCCTCCCAAA GTGCTGGGAT TACAGGTATG AGCCACTGGG
93901 CCCGGCCACA TTTCTAAATT CTTTATAAGT ATAAATTCAT TCAATCTTCA CCAAAACTCA
93961 ATGAAGTGTG AGTACTATTA TTATCATTGT TTTACAGATC AAAACAAGTA ATACAGTCAC
94021 TTACTGAGTT CTATACACCT GGTAATTTTT TTGTTTCGTT GTTCTATCAA TTATTGGGGA
94081 AGGGGTGTTG AAATCTCTAC CTTTAAATCA TGTATGTGTC TATTTCTCCT TTCGGTTCTA
94141 TCAGGTTTTG CTACACATAT TTTGCAGTTC TGTTATTTGG TGCATATACA TTTAGAATTG
94201 CTTGTTTTTC GTATTGGATT GACCCTGTTA TCATTATGTA ATATCCCTGT CTGTTCCTAG
94261 TAATTTTCTT TGCTCTGAAA TATACTTATC TGATATATCA TCCAAAAGAC CACCAGGATG
94321 GCTAAAGAGT AGAAAGGAGA GATTTACTGG CAATACTAAT TTGCAAGCCA GGAAGAGATG
94381 GTCCCAGAAC CTGCCAAAAT TACTCTCTCT TTGGGGAGAA GGAGCAGGTT GGTTATTTTT
94441 ATGCCTCATA GGCTATATAT TACACAATAG AGTCATACAT ATTTAGCACG TTTGGGGGGA
94501 CAGCTATATA TATTATGAGG GGTGCCAAGT GCATTCACAA TGGATAAACA CGTGTAATAT
94561 ACCTCCCATG TTCACTTCGA GGTTAAATTT TGGTTAAAAT GAGGTAGAAT TTAGGTCTTT
94621 ACATCACAAG GTGAACTATA GGAACAAAGT TTACGTGCTG CCTCTAGCAG CTGGCTGAAA
94681 ATGGCTTAAG GTCTACAATT ACGTGTAAGA ATAGAATGTG TGTCAAGGCG GTCCTCTGTC
94741 CAATCAGAGT TGTAGTGGAC TGGACTGTAA ATCAGAGTTA GGAGGGCTTC TGATAGCTCC
94801 TATAGTTAAG GAATTTAGCA AGTGTGAGTT TTTTGGTAGT CTTTGGAATT TAGGAATTTG
94861 CCATGCCAGC CAAGCCATGA ATGCTCTACC AGTAGGTAAC TTTGTTTGCT TAATCTTAGA
94921 GTCTGTCTTA GTTGGTATAG GGCATCTAT TTTGGTCTTT CAGATCCAG ATATTATTAA
94981 TACAGATACT CTTGCAGTTT TGGGCTGATG TTTATATGGC TTATCTTTTT TGCAGCCTTT
95041 AATTTCAACC TGCGTTATGT TTATATTTGA AGTGAGATTC TTGCAGACAG TGTACAGTTG
95101 TTGTTTTTTT TTTTTGAGA TGGAATTTCA CTCTTGTTGT CCAGGCTGGG GTGCAGTGGC
95161 ACAGTCTCAG CTCACTGCAA CCTCCGCCTC CTGGGTTCAA GGGATTCTCC TGCCTCAGCC
95221 TCTTGAGCAG CTGGGATTGC AGCCATGCGC CACCACACCC GGCTAATTTT TGTATTTTTA
95281 GTAGAGACAG GATTCACCAT GTTGCCCAGG CTGGTCTCGA ACTCCTGACC TCAAGTGATC
95341 CGCCAGCCTC GGCCTACCAA AGTGCTGGGA TTACAGGTGT GAGACCTCGC GCCCAGCCAA
95401 ACTGTTTTTT TATGGGTGTA TTTATACCAC ACACATTTAA TGCAATTATT GATATCTTAG
95461 GGCTTAAGTT CATGAAGGGT AGTGTGGGAA CCATAGTCTC TTGGCCCACT AAATGTTTGC
95521 CAGAAATCAC TGACAAGGCA GATTGATTAA TAGGTGAAAA GGCATTTTAC CTATTGTTTA
95581 ACGTGTCTAT GTGGGAGCAT TCAGAATTAA TTACCTAACT TCCCAATGAG TTATAGATGC
95641 TTATATACCA TTTTTAGATC ACAGAAAGAA TTGGGGCTTA GATTCTGGTA AAACAGGTTA
95701 TGGGAGGCAA AAGAGGTTTG GCTTGCAAAG GTGGCCTTGT TAGGTAGGTG AAGCCTCCCT
95761 CAGAAAGAAC AGATGGTAAA TGTTTCTTTT ATGATTTTTA AGTGTCAGAC TCTCAGTCTC
95821 TCCTGGATCT GGGGAAAGGT ATAGAAAGGT GAGGAGGCAT GGCTGCATTA ATGGAGATTC
95881 TCTACAGATG TAAAATTTTT CCCATTTAAG GCAGCTTTGC AAGCCCATTT CTGCCTGCTG
95941 GCCAAGCAGC AGCCATTTCA AAATATGTCA AAGAAATATA TTTTGGGGTA AAATATTTTG
96001 ATTTCCTTTA GACTGGTGGC CTTATAAGAA AAGGAAGAGA CACCTGAGCT GACACACATA
96061 CCCTTGCTCT CTCAACATGT TATGATGCAG TAAGAAGGCC CTCACCAGAT ACTAATTCCA
96121 TGCCCTTAGC TTCCCAGGTT CTAGAACAGT AGGAAATAAA TTTCTTTTCT TTAAAAGTTA
96181 GCCAGTCTGT GGTATTCTGT TATAGTATCA CAAAATGGAC TAAGTAACTA TATTATGATC
96241 ATCTTACATG ACTGATCCCT CCTACATCAT ACACATACAC AGGCCACATT TGGAACATTG
96301 TTAGAGGTTC CTCTGCCCAG TACAAATGTA CTACAAATTA TATATGTATT TTTAAATTTT
96361 TGAGTATCTT CAATAGTATA TTTTCGTTAA CTTTTGTAGT CAAAATGTCA TTATAACATG
96421 TATTCAATAT GCATAATTAT TAGTCAGATG TTTTACATTC TTTCTTCATA CTAAGTGATA
96481 TGGTTTGGAT ATTTGTCCCC TCTAAATCTC ATGTTGAAAT GTAATCTCCA ATGTTGGAAG
96541 TGAAGCCTGG TGAAGGTTT TTGGATCGTG AGGGTGAACC CCTCATGAAG CGCACTCTTC
96601 AGGGTAATCA ATGGGTTCTC ACTTTGAGTT CACAAGAGAT CTGGTTCTTT AAAAGAGTGT
96661 GACACCTCCC CCATCTCTCT CGCTCAGCTC TCACCATATG ATATGCCTAC TCCCTCTTCA
96721 CCTTCCACCA TGATTGGAAG TTTCCTGAGG ACTTGCCAGT AGCAGATGCC TGCACCACAC
96781 CTCCTGTACA GCCTGCACAA CCGTGAGCCA AAAAAAATTA CTTTTCTTTA TAAATTAGTC
96841 AGTTCAGGG ATTCCCTTAT AGTAATGCAA GAACGAACTA ACACACTAAG TCTATTTCAT
96901 ATTTACAGAA TAGCTCAATC TGAAGTACCC TTTTTCAACT TCACAGTAGC TACTTGTAGC
96961 TAGTGGGCAC TGATTTGGAG CGTGTTCAAG GGTGAATTGT ATTATGCAAT TAACAGATTT
97021 TTTTTATTGT TTTCGCAAAC CACGAGGCAT AGATTGTCTT ACTTTCTCTG CTCCTGGTGT
```

```
97081  TGGAGTTGTT ATTGGGAAAC AACTTATTTT CCTCTTATAT TTATATGGAA TAAATAACCC
97141  CCAATATTTC CCTCCCCAAT ATCTGCCTTT TGTATGTTTT TTGAAGGCAA GTGCCTAGAA
97201  TTTACTGTTT TTGAAGCACT TACTGAAAGG ATTGCCATCA AGTTGTTTTG CTAATAGTAC
97261  ATGCCAGGCG CTTGTTGGTT TGCTTAATTC AAGGTAACTT GGATGAGAAG AAGAGTTTTT
97321  CTCATCCATG GCTCAGTGGA GTATAGATTA CTGATATTGT GACTGGATGT ACTCCTGCTT
97381  TCTAGTCTGA GTTTTGAAG CTACCCTTAA TCTTGGTTTC AATTTTATCT AGCCCTGTAC
97441  ATATCCAAGG CTCTTTCCAA AATGGTCTAC GATTTGTTTA GGAAGTTAGA ATAGCTGTAC
97501  TTTCTGAACC ACGGTTCCTG ACATTTTCTG GACTTCAAAC ACATCCAGCA TTTTATCGAA
97561  GTATTTATCC TTCCTACTTG GCTGGCTTCT TCCTTGCCTT CAGGTCTGAA TTCAAATGAC
97621  ATTCTCCTGA TGAAACTTTC CATCCTTATT TCTATTCTTT TTTCTTATCC CCTTTCTTTA
97681  TTTTTCTCCA CAGCACTCAT CACTTATCTC TACATTTTCA TTATGTATTT ACCTTATTGT
97741  GCACCTCCCA CTACAAGACA AGTAGCACCG TAAGGAAACA GGTTGTCTGC TTTTTCACTG
97801  CTATGCTCCC TGCACCTAGA ACACTCTCTG GCACTTAGCA GGTTTTCAGT AAATATATGC
97861  TGAACTAATA ATGCTGGATA TACATCTCCC TCATGAACTC TCTAAATCCT TCTAATTTAC
97921  ATTGATCAAT CTTCTTTTCC ATGTGCTTTT GTATGATTTA TTGCTCAAAA TCTTTATTTT
97981  ATATGCAGAA CGTGCACTGC TATTTAATCT TCATGTACGT AAGTCCTCCC TTCTCTGAGT
98041  ATAATCTCTT CAGGGCACTA TCTGAGATAA CTTTTTAACA TCTCCATCAT GAATCTTGTA
98101  CCTTTTCAAA GAAAATGAGC CAGTGATTAC TGATGTTTAC GGCTATTGTT GAGGGTGAAG
98161  ATCATTATAA TTTTGAAAAG GGAAGTTGAA TATTGTGAAG GGAAAGATAA CACTAGAGTC
98221  AGAAGACTTG GGAGAAGGCA AAAAACAAAC TAAAAATGAG CACTTTTAGT CTCCTGACAG
98281  TTTCTCTGAA TCAAATCCAT AGTTCTGTGA CAGCGTTGGC TTAGAAGCAG ATTTTTTTTT
98341  TTTTTTTTTT TGAAATGGAG TTTCGCTCTT GCCCAGGCTG GAGTGCAGTG GCACGATCTC
98401  GGCTCACTGC AACCTCTGTC TCCAGGGTTC AAGCGATTCT CCTGCTTCAG CCTATGGAGT
98461  AGCTGGGATT ACAGGCTCCC ACAACCACGC CCAGCTAATT TTTTGTATTT TTAGTGAAGA
98521  CTGGGGTTTC ACCATGTTGG CCAGGCTGGT TACGAACTCC TGTTCTCAAG TGATCTGCCC
98581  GCCTTGGCCT CCCAAAGTGT TGGGATTACA GGCATCAGCC ACCGTGCCCA GCCAGGAGCA
98641  GATTTTTTTA CACTCATGTT TCTTTTTCCT TCTGTCATCC TGTTTCAGTA TAAGCAGACC
98701  ACAGATAGAA GTAGTAGATA CCTCAGAAAT TCCTGGAATA ATTAATCCAC GTTCATCTGT
98761  ACTCCATCTG CTCCTATCTC ATGGAATATA AAAGGAAAAA CACCAAGATT TCCCTAGGCA
98821  ATCTGTCTTG ATTTTAGGTT CCTCAACAGG AGAGCCAGAC AATGGCTGTA ATAATATTGT
98881  CCCGGCCAAG GAAAAACTTC CCCTTTGCCC TCCCAAGGTT TATGGAAAAT TACTGGCAAA
98941  ACACAGATTA ACTGGAGAAA AGGCATATAT ATTTATTTCA TCACAATTTT ACAGGAGATT
99001  TTAGAATTAA GACTGAAAGA TACAGGGGAA ATTGCCCATT TTTATGCTTA GGTTCAACAA
99061  GATAAACAGC TGTATAGGGT ACGATCTAAT GCTAACAGAC TGAGTGGGGA AGCCCGCAA
99121  GGCTTGTCTG TCAAGATTCT TCTTGACCTC TCAGTGCAGC ATTTCTTCCT TCTGGTTATA
99181  GGACAAGACT CTCTTTTAGA ATGGGGGGTC TTATGACCTA CAGGCAAACA AGGTAGGTTA
99241  GAGTAATACT TTTAGGTTTT ATGGCTGGTT CTAGGGAAAA GGAGTTCTGG TTTGTATGGC
99301  CTACCTTGAG GAGGAATTCT GGTTTCTATG CTAGACTTT GGGGAGAATG GGACTTACAG
99361  ACAGGAAGGC AGAAGGTGG CAGTGAAACA CTTTTATAAT CATAATCCCA TTTTGAGTAT
99421  TTCTGTGTTA TGGAATGTTT GTTCTCTCAT TTCCTGAAAG ATTCCAGAGA CTCCTCATTC
99481  AGTGTTGTGA AAAAGTTCAG GAAATGCAAC TCAAAATGT GCCACTTTGT TACGCTGATT
99541  TCTTTGAACT GAGGGCACCT AGGAAACAGT AAATTCAAGG AAGGGCTTTC GCTGAACTCT
99601  AATCAAAAAT TTGAAAATTA AAAAAAAATT CAAAAAGGAA TTTAGTTGTT AAGATTCACT
99661  TCCCTGGGGA ATCTCATCAA CCAGAGAAGA TTAACTGTAT CACAGGAGAG GAGACTGGTG
99721  GTTAACACCA TCTAAACAGA CTTTGTCACA GCTGTCACCT ATTCTTTGAA ACACCCATTT
99781  ATTTTTCTCC AAAATCATAT ACTCTCCCCT AAGTTGCCTA CATCCCCCTT CTTTCTCCCT
99841  TATGAATCAA GAGAGCTTAT AAGCTTCTAC AGTTCACTGG GATTTGGGGT ATTCGCTTTT
99901  CTTCCCTCCC ACTCCCCCTC CCCTTTTTTT GTCTTTGAGA CACAGTCTTC TGGCTCTGTC
99961  GCCCACGCTG GAGTGTGGTG GCTCTATGTG AACTCACTGC AACCTCCTCC TCTCGGGTTC
100021 AAGCGATCCT CCCACCTCAG CTTCTCGAGT AACTGGAACT ACAGGCGTGC ACTACCAAGC
100081 CCGGCTTTTT TTTTTCTTTT TCTCCCCCGT TTCTTTTTTG GTTATTTTAC TGGAGACAGG
100141 GTTTCTCCAT GTTGTCCACG CTGGTCTCGA ACGCCTGACC CGCCGTCCTC GGCCTCCCAA
100201 AGTGCTGGTA TTACGGGCAT GAGCCACTGC GCCCGATTTG AAGGACCTCT TAAATATCTA
100261 TTTAGAAATT GGTCGGAGTC CACTCCTTTC CAAAAACATG AGTCACAATC CGGGAAAAGC
```

Figure 1 (Page 31 of 73)

```
100321 ACGAGCGGCT GAAAGTCAAA ATAACCAGAA CAAAACCTCC ACTCATGCTT AAAAAAGGTA
100381 TTTTGACAAA ATCCTAATTC GGCCAATTAT TATTAGTATT CAAGTCGAAG GCTCGTCAAG
100441 CCAGACTGGG GATTGGGTCA AACATAAACC TTACACCAGA CGGAAGGATT ACATGCAAAT
100501 GAAGGATGCA GATTCTGATT TCCCATTGGG TATTTGACAT TAGCCAATGG GAGAATTCCT
100561 CACAGCCTAC CTCCAGTCAG TATAAATACT TCTCTGCCTT GCGTTCTAAT GTAGTTTCAT
100621 TACATTTTCT TGTGGCGATT TTCCCTTATC AGAAGTAGTT ATGTCTGGTC GCGGCAAACA
100681 AGGCGGTAAA GCTCGCGCCA AGGCTAAGAC TCGGTCTTCT CGTGCAGGTT TGCAGTTTCC
100741 TGTGGGCCGA GTGCACCGCC TGCTCCGCAA AGGCAACTAC TCCGAGCGCG TCGGGCTGG
100801 CGCGCCGGTG TATCTCGCGG CGGTGCTTGA GTACCTGACC GCCGAGATCC TGGAGCTGGC
100861 GGGCAATGCG GCCCGCGACA ACAAGAAGAC CCGCATCATC CCGCGCCACC TGCAATTGGC
100921 CATCCGCAAT GACGAGGAGC TTAATAAACT CTTGGGGCGT GTGACCATCG CGCAGGGTGG
100981 CGTTTTGCCT AATATTCAGG CGGTGCTGCT GCCTAAGAAA ACTGAGAGCC ATCATAAGGC
101041 CAAGGGAAAG TGAAGAGTTA ACGCTTCATG CACTGCTGTT TTTCTGTCAG CAGACAAAAT
101101 CAGCCTAACA GCAAAGGCTC TTTTCAGAGC CACCTACGAC TTCCATTAAA TGAGCTGTTG
101161 TGCTTTGGAT TATGCCGCCC ATAAAGATGT TTTTGAGGTG TTTTTAATGG CTTTGAGTGT
101221 GGCACTTTTA GTAATTTGTC CTGCAGAAAT TAGATCCATA GAAACCTCAG GAATTCTAGG
101281 TATGTGGGAG AAGTGCCATG CAGCACAAAA CATGTTTACA GGGGTGATTC GCGTTAAGTT
101341 TCACACACAG CAGTTACTAC ATTTTAGAGG AAGGAAATTA TACCCATGAG TGCATTCCTA
101401 ACTATCTTGA ATGGAAGTGT TAAAACCCGC ATGCCCCACA CAAGTTTGAA TATGTCATAC
101461 CATTTGCTGT AGCAATTAAT GGCATACACA ATTGAGAGCA CACACATTAC CACTGAACAT
101521 TTGAGTATGT ATTTCCCAAA ATGAGCTTTT TTCCAGTTTG GGGATGTTTT GCTTTGTTTT
101581 GGGGTGGAGT CTCCCTCTCG CCCAAGCTGC AGTGCAGCGG CGTGATAACA GCTCACTGTA
101641 ACCTCGAACT CGGGCTCAAG CGATCCTCTT GACAGCCTTC TGAGTAGCTG GGATTACAGG
101701 CGAGAGCCGC CACGCCCGGC TAAGAGCATT TTTCTAATTG CCCACACTTC TTATGCGACA
101761 CCCAGAAAAA TACAATTTTA AATAAAGCGC ATATGCAAAT TTCCCTAATC GTCTCCAATA
101821 TTCTCTGATT TCTTTTTTAT ATTTTAACTA GAAACAATTG GAGGTTTCCG CGTTGCTTTG
101881 TGTGGTTGTA AATTTTAAGA CTTCAGGAAA CTTTTCCAGT ACAAGACTTG TCCACAGTGG
101941 ATATAGCAGC TAAGGGGTTA ACAAAATGAC GTCAGAGTAG CTACGGTAAT GGGCAGGAGC
102001 CTCTCTTAAT CTGCAACCAG GCACAGAGAT GGACCAATCC AAGAAGGGCG CGGGGATTTT
102061 TGAATTTTCT TGGGTCCAAT AGTTGGTGGT CTGACTCTAT AAAAGAAGAG TAGCTCTTTC
102121 CTTTCCTCCA CAGACGTCTC TGCAGGCAAG CTTTTCTGTG GTTTTGCCAT GGCTCGTACT
102181 AAACAGACAG CTCGGAAATC CACCGGCGGT AAAGCGCCAC GCAAGCAGCT GGCTACCAAG
102241 GCTGCTCGCA AGAGCGCGCC GGCTACCGGC GGCGTGAAAA AGCCTCACCG TTACCGCCCG
102301 GGCACTGTGG CTCTGCGCGA GATCCGCCGC TACCAAAAGT CGACCGAGTT GCTGATTCGG
102361 AAGCTGCCGT TCCAGCGCCT GGTGCGAGAA ATCGCCCAAG ACTTCAAGAC CGATCTTCGC
102421 TTCCAGAGCT CTGCGGTGAT GGCGCTGCAG GAGGCTTGTG AGGCCTACTT GGTAGGGCTC
102481 TTTGAGGACA CAAACCTTTG CGCCATCCAT GCTAAGCGAG TGACTATTAT GCCCAAAGAC
102541 ATCCAGCTCG CTCGCCGCAT TCGCGGAGAA AGAGCGTAAA TGTAAAGTCA CTTTTTCATC
102601 AGTCTTAAAA CCCAAAGGCT CTTTTCAGAG CCACCCACTT ATTCCAACGA AAGTAGCTGT
102661 GATAATTTTT TGTTGTCTTA ACAGAACAAA TTTCTAAGGA CCCCCCGGA AAGCATTAGA
102721 CTATGGTCTT AAAGTTGATT AACAGAAATA ACGGTTTGGT CAGTCTTGCA GTGTAGGTTA
102781 TTTCTGACCT TATTAAGGTG CTATTTGGAG AGAAGCTGTG TAAGTCCACT ATCATTCAGG
102841 CCTCTAGCTT GCTATGATTA GCATTTGTTT AAACAACTTT GTAAGAGTAA GGGAAAAATC
102901 TGGTAAGTAG TTAACTGGCG CTTACTAGGC ATTTTTGCAA AGCTTTGAAA AGATTAGAAA
102961 ATTGTGTCTT GCGAGTTCCA GTGTCTTCCT CAAAATGCTT AGGAAGATTT TCTCAGCTCA
103021 ATACATAGTC CCCTAGGTTT TCTCATATAT TATATATATA TATATATATA TATATACTGT
103081 TAAATTCATT TGGCTGTTAA CATTAACCTG AAATTTATTC TGGTGCAAAA TGTGAGGCAG
103141 GGATCTAACT GGCTCTCATT TTATCCATAG CTAGCTACCC ACTTTAAATC TGTCAGTCTG
103201 TCGACCAAGC ATAATTTAAT CCCTTATATA TGAATTTTTA TATGTGTGGC TTTGCTTGTA
103261 AATAGTCTAT CTGGTTGCAT TGCTTTGTCT CCTCTAGGAC TATGCACCAT GACATGCCAC
103321 ATTCTTTTTT TCAGTACTTC TTGCCTGTAG TTATTAAAAT CTAGAATTTA CAAGTTTTAA
103381 CCATTTTCTT TCTGTTGATC TTGCTTTTCG GTTTTGGAGG TTGGGGATTG AGTACTGGAA
103441 GAAAATTTAG AGGGATGGGA ATACTGTACG CAAACAAAAG TAATATTTAC TTTAAAATTT
103501 TTATATTTTG TATTTTTTTA TCATATAGCT TTTACATCAC ATTTTACAGA CTAACTTTAG
```

Figure 1 (Page 32 of 73)

```
103561 AACAACCACA GAATGTCCAA CATTAAAACT ACTAATTCCA AAGACCTTGC CTCACATTCT
103621 TTTTTACAAT AAATATTTTT TACACCTAAC ATTCTTTCTT GGCCTACATC TAGAATGTAA
103681 ACTGATGTAC CATACTAAAA TCGCCTGACC AACTGTCAAC AACAACAAAT CACACACACA
103741 AAAGATTAAA TTTGAATTGC ATCGTTTACT TAAATTCATT TGTGTTCCAG CTTTTAATAA
103801 GGCAGTTTTT GGTTTATAAA GTAATATTTG CATTTTAAAA ATTATGAAAA TGAATATGTC
103861 AGTTTGTTTT ATGATTCGTT TTTCTTGACT CTTATACAAG CGACTCTAAC TGGCATAGAC
103921 ATTTGTTATC CACAGACAGT ATAGATATGT TAGAGATGCC AATGGACTTG GTCTATGCCA
103981 AGGTGACTAC TCACAAGCTC TGGGCCCAGC TGAAGGTCAA GTATTTTTTT TCCAGTTATA
104041 GATGTGCTGG ATCTGATGTA TAGCGCTTGA CTTTTTATAT TTTCTTTATC TGTAGGAAAC
104101 AAATGTGTTG GAGGTACTGG GTCTGACGAA TAGCATAAAA GAATAAAGTT ACATTACTGT
104161 CTGAGGATCA GATGGACAGG GGGTGGTAGC TCAGTCCAGC TATTTTCCAC TCCCTCACTT
104221 ACATTCTTTG CCCCCTCCTC AACAGAACAA GGATTCTGCT GTAACTCTTC ATTGACAGTT
104281 GATATTTAAA AATTAACGAA TGGATGAAAT TCTCATTTGT GAAAGAAAAT TTATTGAGCA
104341 TTTTGTATTT GTGAGTAGTG CAAACATTTT AATATTATAT TAAGAATCTA TTGTTTTGTA
104401 TTAGAGGAGT AATTAAGGAG AGATTGGAGA CAAAAGGGG GTGTTGTTTG CAGAATATAC
104461 CATCCAAAAA TAGACCACTG TGGGATCAGG ATTCTTTTGA GCTAAAGGCA CTTCAAAAAC
104521 AGCATTCAAG AAGGGAATTC TTCTAAACTT TTCTTTCTGA AAACAGGAGA TAAAAGTTCC
104581 AATGTGAAAA ATGCTCTGCT TGTACCAGGT GAAAAGACAT ATTCTTCAGC CCAGAGGCAT
104641 AGATGAGATA ATTCTGCACA AACACAGCAG GGAGTCATAG CCGAGAGACT TCTATACACA
104701 AACAAACCTT GTTAAAATAA TCATATATTC CTTTAATCTC CTCATATGGT TTACTTTCCC
104761 ACAATTGCCT CTCTTTAACT TAATGTGAAA GCATTTAGCT TTTGCCATTT CTTTGGGGCT
104821 TCACTTTTTT ATGAGGGTTC TCCTGTCCCA TAAAATTTAC ATTAAATACA TTTGTATGCT
104881 TTCATTCTGC TAATCTGTTT TATGGCAAAT GAATTATCAG GTCCAGCTGG AGACCCTAAC
104941 AGAGTAGAGG TAAAATTTTG CCTCCCTACA AGATAGAGAT TGTGTGCATT AAATGTTGTT
105001 TGTTCCCAGT TGTTCAGTTT GTCAGGCCTC TGAGCCAAG CTAAGCCATC ATATCCCCTG
105061 TGAACTGCAC GTATGCCTCT AGATGGCCTG AAGTAACTGA AGAAACACAA AAGAAGTGAA
105121 AATGCCCTGT TCCTGCCTTA ACTGATGACA TTACCTTGTG AAATTCCTTC TCCTGGCTCA
105181 TCCTGACTCA AAAGCTCCCC CACTGAGCAC CTTGTGACCC CCACCCCTGC CAGCCAGAGA
105241 ACAACCCCCT TTGACTGTAA TTTTCCACTA TCTACCCAAA TCTTATAAAA CGGACCCACC
105301 CCATCTCCCT TCGCTGACTC TTTTCGGACT CAGCCCGCCT GCACCCAGGT AGAATAAACA
105361 GCCTTGTTGC TCACACAAAC CCTGTTTGAT GGTCTCTTCA CACGGACGCG CCTGAAACAG
105421 TTTAACAGGG TTTTTCCTGC CCAGTCACAA CAAAGTGATG TTATGCTGCA GGCTGAAGTT
105481 TACAGCTAAT GCTGTTGAAG TCTAAAATCA GTTTGGTTT GTTAGATTTG GGTGAGATGG
105541 CTAAGATTCT CAGAGAAAGA AGTCAAGTTT GGGGTGCATT TTTCAGACTT AAAAATTTAG
105601 CAGTAGCCCT TGCAGTTTTT CCAATAGAAG TGATTTAAGA ATGTTTTCAG GAAATTTAAA
105661 ACAACAGTGA GAAGCGTGTA TGGAGAGTTG AACTACACTC CAGACTTGGC TATAGGAAAG
105721 CACGAATGCT GCTATTGTAT TGCACCTTGG AAAAGAGAAC AAAGGAATAT TTCGGACAA
105781 TTTTAACATG TCACATATGA AAAGCTAAAC GGAATCTGTC AACACCTTGT ACGTTATTAC
105841 AGGCTGTGAT TTTAAAAAAA CAATCCTTAC TAATACATAC ATAGTTGCTG CTAGCAATAT
105901 AGTGTTGGGA GTAAAAACAC GAAAATGAGA GTTCAGGACA ATATCCCAAC TCTGAGCAGA
105961 TTTTTTTAAG TAGTAACATC TAAAATTAAA CCATATTATG TAATATTTAT TTCTTTTCCA
106021 CAGTCTCTTC TCATGCCTCG TTCACATTAG CTAATTAAAA GTCCCCTGAG TATCATCATA
106081 ACCGATTTA CAGATGAAGG CACGGTTGCA ATGAGCTATC ACCCTCTTCT GAATGAGACA
106141 GTACAGTGTG AAGGATAGCA AAACTCCACT CCCATCCTCT TAGGGCTCTG GCTGGACCAG
106201 CAAATTAAAT TAATGTAAAA TGGATTAACA GGAGAAAGGT ATATGCATTT ATTTAACACA
106261 GGTTTTACGT GACACAGGTG CTCTCATAAG GTAATGAAAG CCCAAAAAAA GCAGTTAGCT
106321 ACTTATATAA TGAATTGGAC AATTAGTAAA ATGTAAAAAT GCGCTAAAGC AAAGGGATTT
106381 AGGCTAGAAT ATATAACTGT GTAGAGAAGC GCCCAGCAAG GGCTAGTGCA AGGTTTGTAC
106441 AGAATTCTCT TGGCCTCAGC CTCCATCCT TGAGAAGAAT GTTGCTTTTT TTAAACTACA
106501 GTGAGAACAT CTTTCATATG AGAATTTCAC CTACTGCTTC TAAGAAACAG GTCAGCTTTC
106561 AAGAAAACAT AAGGCCAGAG TGATCTTTTC ACGCCTGCTC TTTTAAGTAC CTTTGAATAG
106621 TCAATATGTC TTCAAGCACT TGAAAGACTT AAAAAGTTTA CCACTCCGGC ATATTAGTGA
106681 AAGCCCTTAA TATAAGCCCT TATTAAAATT CTCAGTCGAG GGTATAAATT CAGATTCAAA
106741 TAGTAGTGTC GTAACGGGA GGGAAAAACT AAAGGGATTA AAAAGTGAAA CTATTGTGTT
```

```
106801  CTCCCTCGCA  GTCCTTAGGT  CACTGCCCCT  CGAGGGGCGG  AGCAAAAAGT  GAGGCAGCAA
106861  CGCCTCCTTA  TCCTCGCTCC  CGCTTTCAGT  TCTCAATAAG  GTCCGATGTT  CGTGTATAAA
106921  TGCTCGTGGC  TTGCTTTCTT  TTCGCGTACC  TGGTTTTTGT  TGTCAGCTGG  TTAGACATGT
106981  CTGGTCGCGG  CAAAGGCGGT  AAAGGTTTGG  GTAAGGGAGG  TGCCAAGCGT  CACCGAAAAG
107041  TGCTGCGGGA  TAACATCCAA  GGCATCACCA  AACCGGCCAT  TCGGCGCCTT  GCTAGGCGTG
107101  GTGGGGTTAA  GCGAATTTCC  GGTTTGATTT  ATGAGGAGAC  TCGTGGCGTT  CTCAAGGTGT
107161  TTCTGGAGAA  CGTGATCCGG  GACGCCGTGA  CCTACACGGA  GCACGCCAAG  CGCAAGACTG
107221  TCACTGCCAT  GGATGTGGTT  TACGCGCTCA  AGCGTCAAGG  ACGCACTCTG  TACGGCTTCG
107281  GCGGTTAATC  TTTTCGTCAG  TTTTCTTCCA  ATGGCCCTTT  TCAGGGCCGC  CCACTCCCTC
107341  TCAGAAAGAG  CTGTGATTGT  ATTCTTTCGG  ATGGTAACAT  CTCAATGGCT  TTACTCGGCT
107401  ATTCTGCCTA  GTATGTAGAA  CTATTATAAA  CCAGTTGGGA  GAGACCAGGT  TGTTTGGTCT
107461  GAGTGGCTGC  TAAAGCAGAA  ATCAGCTAAG  TAAACGAGGT  CTCCGAGATA  AGTGAGCTAT
107521  AAACTTCAAT  GCTATAGTTT  TGACATGTCA  AGCAACTTAA  CGTGCAGCGC  GAGTCCGATA
107581  AATGAGTAGC  TCAGCTTTTT  AGTTTAAAA  ACGAGTTGTG  CGTTATTTGT  ACGAGAGCCT
107641  AAGATGCTAG  CTGCCTGGAA  CTGAGTAGGT  GGATTAAAAT  GGGTGTCAGG  TCTGTTTTCC
107701  CAGGCGTATC  TGACTTAACG  TCAGCAAAAG  CTGTACTTTT  AGCTTCCCTG  GTAACACCTG
107761  CCGTCCTTAA  CCGCCCCTG  CCGGTAGCGC  CAGAAGCCTT  TACTTCCATT  TCTAGTTGAG
107821  CTTGGCGTCC  TGCTGAGTGA  CGTCACCTCC  CCCTTCTCTG  GAGTAGGACT  GGCGGTTAAA
107881  GCTGCTTTGC  TATTTTCAGT  CCTCAGGCTG  GAGGCTCCCC  TAAGCAGGCT  GCCTACGCAG
107941  TTCGTAAATT  CCCACTTAGT  AGACTAAGGG  AGTCTGTTTT  ATAAATAAGG  ACTCAAATTT
108001  CTTCTGACTC  CGAGGTCCGT  GGCAGCAGCT  ATAAGATGGA  AGCCCCTCT  GATGTAAGAT
108061  TCTCAGATGA  CTTGCATCTT  CACTGTACCT  GTCAACCCAA  TAGTCTTCTA  TTCCTGCCTT
108121  AAATTGTAAA  TTCCAAAACT  GATTTAATTG  TGAAAGTTTC  AAACTGTACG  ACCTAGGAAG
108181  TGTCAAAGTT  AGGTGACCAG  ATTTTTAGAA  GTCAGCCAAA  TATTCAGCAT  CTTTGATTTA
108241  GTAACAAATA  TATTGATGGC  TACTTCAGCA  AAAAAAATCA  ACTTTGTTTT  CTGGTTACTT
108301  TGCTAACAAG  CTTCTCCTGA  CAGGAGGATA  TAGTGAATAG  GCAGTTGAAT  AAGTGAGTTC
108361  GGGTGAGAGG  TCTGAGCTGG  AGATAAAAAT  GTGTGAGTCA  TCAGCAGATA  AATAAATGCT
108421  GAGACCAGAT  GAGATGGCTA  AAAACTGAAA  CATAATGTAG  TGCAGCATTG  TTTGTAATAG
108481  TAAATGAGTG  GCAACTGTAA  AGTTTTCATC  AGAAAGGACT  AGAGTGATCT  ATACATCCAT
108541  AAAATAGAGT  ATTTCTCTAC  ACAGCCCTAC  TAAAGAATGA  GAAAGCTGTA  CTCCACTACA
108601  TACTCTGGTG  TACTCTGGCT  CAGTTCTTGG  ACTCCTCTTT  TCTTGGCTAA  CTCAACTGGC
108661  CTCACCACTT  ACATGCTCTG  TGCTCTGTCA  AATAGTTTGT  TCAACAGAAC  ACCACGGCCT
108721  AGCTGTAAGT  GCCACGTTAA  CTTCTAGCAA  TGCCAAAGCC  TGTGATAGTG  GCAGCTTCGG
108781  GCTGTTTCTC  ATTCCCGGGA  TGCCTAACCA  CCTCTCCAAA  TTCTATCAGT  TTGCTTCCAC
108841  CCACTTCAAG  CTTCAGAACG  AAACATAGAG  CTTAAGAAAT  ATAGGCCCGG  CAAGGTGGCT
108901  CACGCCTGTA  ATCCCGGCAC  TTTGGAAAGC  TGAGCCTGGT  GGATCACCTG  GGTCAGGGG
108961  TTCGAGACCA  GCCTGGCCAA  TATTGTGAAA  CCCCGTCTCT  ACTAAAAAAA  AAAAAAAAAT
109021  TAGCTGGGCA  TGGTTGCGGG  CGACTGTAAT  CCAAGCTACT  CGGGAGGGTG  AGACAGGAGA
109081  ATAGCTTGAA  CTCGGGAGGC  AGAAGTTGCA  GTGAGTTGAG  ATCGCGCTAT  TACACTTAGG
109141  CCTGGGAGAC  AAGAGTGAAA  CTGTGTCTCT  AAATAAGTGT  TTGCAATTAT  AAACCATCTC
109201  CCTGACCTTA  AATCTCTAGA  CTCATATACA  ACTGCATATT  TGATGTATCT  AATTGAATAA
109261  TGGGCATCTC  GAACTTGTCC  AAAATATGTT  TATACGTAAA  CACCAAGTCT  GTTCTTCCTC
109321  TGATATTTGT  CATGTCAATC  AATAGAACTC  CATTCTTCAA  GCAGCTTGGG  CCAGGAATTG
109381  TGCAATATTG  TTTGTCCTGA  GCTTCTTACA  ACTTTCACCC  AATGCAGTCA  GCTCTGTTGA
109441  AAATCAATCA  GAATACCTTT  CATTGTTTTC  TTTGCTGCTT  CTCTAGGAGC  AAGCTGCCAT
109501  GGCGGTTTGT  CTGAATGACC  ACAGTGACCC  CAAACTGGTC  TTTGTTTTCA  CTTTTAATCC
109561  CCCTGTCATA  CAGTTTTTTC  TCTATCCAGC  ATCAACAGTG  ATCCTTTTTG  AAGGTATTAT
109621  GTCCACTGTC  TGCTGAAAAG  ATTCCACTGG  CTTTCCATCA  CCTTCATAAT  AAAAACCAGC
109681  ATCCTTATCA  TAGCCTACAA  GTAAGATGAC  CAACCATTAC  AGTTTGCCTG  ACTCTCAGGG
109741  GTTTCTCAGG  GTGTAAGACT  TACAGTGCTG  AAACTTAGAA  AGTTCCAAGC  AAACTAGGAT
109801  GAGCTGCTCA  ACCTACTAGA  TCTGTACTCT  GGCTACCCTC  TGACCTCATT  CTCTTCGCAG
109861  TTCTTTCTCT  TCACTGACCT  TGCTGTTTCT  GGAATGGACC  AAGCATTTCC  AGCATCAGCA
109921  CCTTTATATC  TATTCTTTCT  CCCTAGAAGG  GTCTTGTCCT  GGATATCTGA  ATGGCTCTAG
109981  ATCTCATTTC  ATTCAAGCCT  CTCCTCAAAT  ACCAACCTTA  CGAAAGAGAC  CTCCCATAAT
```

```
110041  CATCCCTTGT  AAAATAAGCT  TTTCTGCTCA  TTTAGCATAT  ATATATATAG  TTGACTATCC
110101  TCAATAGCAT  ATATATATAA  CATTTCCCCA  CCTAGAATTA  TATATGTAAT  AATATATTTA
110161  ACAAAAAATA  CATATAACTA  GATATATTTT  ATTTTGTGTT  TGTTCTCTCT  CCCCCAACTG
110221  GAATATATTT  TTTGAAGGTA  GGGACTTTGT  TTTGTCCCAG  AAGTATCCCT  AGCACCTTGA
110281  ACAGGGCTGA  CGTTTAACAG  GTAGTTTATG  GAGGTTTGTT  GAATGAAAGG  ATGTGTGAAT
110341  TTTCTATGTA  AGTCTCCAGG  CTCTCCACTA  AGCCCACCAG  AATGCTAACA  CAATCAATTC
110401  CCCATCTCAT  TCCTTGACCT  GCCACTGCCT  GAAGCAATCA  GCGTGCAGTT  TCTCTTTAGA
110461  AAATCTGGGG  GATAGTCTAG  GGGTTGCAAA  TTAAGCAACA  TTATCTTTGT  TCTGAACAAG
110521  GACTGCATGA  GTGTTAGGAC  TGAAGAAGGC  CCAAGGTGGT  GGTGGGTATG  CCTAAGATGA
110581  GTATGACATA  TCAGCAATGC  TATGAACATA  GCAATGCTAT  GAAAGGCCAG  GCAAAACGTA
110641  ACAGGAGCTA  GTCGTGGCTT  ATTGTTACAA  CGACTATACC  TCCCATATGG  GTAATCGATA
110701  TCCACACACC  CCTCTACATT  GACTCTGGAA  TTCAGGAAAG  GGAATTAAAA  TTTTCTAACT
110761  TATGTACCCC  AATGATTTCA  ACAATATCTG  GCATATGAGA  TCAATAAATA  TCTTTAAAAT
110821  ACCAACTAAG  AAAGACATAA  AATGACCCAC  CCTCCATACC  AGGCTCATTT  TTGCTCCTCT
110881  GATTCCTGAA  ACTATCCAGA  ATGCAGCTAT  GAATTCTCTC  CATTGTCAGT  TTTAAATTAA
110941  GCCAAGCTGG  GTACTTGTGT  AATTCCTCAA  GAAATCCTGG  ATGAAAACTG  TCAGGTGGAA
111001  AACAGGACCT  CAAAATAAAG  AGACATCCAT  CACTGAAGCT  AACATCGTGA  GGCTGAAATC
111061  AGTCCTATAA  CAATGGTACC  AAAAAGAGCA  CAATGAGAGG  CATTTGTGAA  TATTTACTCA
111121  GATGAGAGTA  AGATATTTCC  CTATCAGCTA  ACCTGAAGTT  CACATCCCTT  TTCCAGCTGA
111181  GTTCTGAAGC  TAGATGTACT  TAACTGGAAC  ACATAACTGC  ATCAGGAACA  TCCTTTAAAA
111241  CTATGGCTAC  CATGGCTTGA  CTGGACAAAC  CCCAGGCTTC  CAGGTTTAGC  ACAGGTGGCC
111301  CTTCACAGAC  CAACATTGCC  TATGCTACCA  ACCTCATGTC  CTACCACCCT  GCTTGCATCA
111361  TTTCTCTCTC  TGCATATATA  AAAATATATG  TGTATGTATA  TAATCAGCTT  TATTGATATT
111421  TAATGTACCA  CAAAATTTGC  CCACTTTAGG  TACAGTTCAA  TGAATTTTAC  CGTGTTTTCT
111481  TAGTTGTACA  ACCATCATCA  CAATTTAATT  TCGGAATATT  TCTATCACCC  AAATTTCCAT
111541  TTCTGCGTAA  AGGGGGAAAA  AAAAAGGTTA  ACTGCTGAAG  GCCGCGGTAA  CACTGAAAAA
111601  GGTGCCTTTT  CTCTCTAAAA  CAGATTTTAA  TCTCCCCTGA  ATTTAGTGTC  CTGGGTATTC
111661  CAGGAGTCTG  AATAGGGTTT  CAATTTTCAG  GGTCTTTTTA  ATAGAGTAAA  ACTGTATTGG
111721  TGGCGATAAA  TTTAGTATTG  CTCTCAGTAC  ATGATTGAGG  GATACTTAAA  TGTCTCTGTG
111781  ATTTTATTTC  ATAATCGCTA  AAAGATGGTT  TTTTTTTTTC  CTAAAACAGG  GTTTTGTTT
111841  TTTCTCAATA  AGCTTCTTAG  CTTCCCCTCC  GGCTCCCTGG  CTTGCCTCAG  GAAATATTAG
111901  CTCATCAGTT  CTGATTGGTT  GACAGCTACG  AATGGCCCTC  ATTGATTGGG  CAGCGCTTCT
111961  TTGTCCCTTG  GAAACTAATA  CAAATTTTTA  ACACTACTTT  TTTTCCACTC  TTTCTTCAGA
112021  GTTGGAATAT  CGTTGCTCCC  CTACCCATAT  GTAGTGAGTG  GAGGGCAAAC  TTGGAGTTCC
112081  CCTAATCTTT  CCTTTTTAGG  ATGTCAGCTC  AGTATCATTC  ATCTTAATTA  CACATTGAGC
112141  TTCTTGACTT  AATGGATACA  GCTCTTCTTT  TGTTTAGTTG  GGCGGCCCTG  AAAAGGGCCT
112201  TTGGTTCAGA  AATGCAAGCT  GTGGAGAAAT  CAGCAACCTT  AACCGCCAAA  GCCATAAAGG
112261  GTGCGTCCCT  GGCGCTTAAG  CGCGTAGACC  ACGTCCATGG  CAGTGACTGT  CTTGCGCTTG
112321  GCGTGCTCCG  TATAGGTGAC  AGCGTCACGG  ATCACGTTCT  CCAAAAACAC  CTTGAGCACC
112381  CCGCGAGTCT  CCTCGTAGAT  CAGACCAGAG  ATCCGCTTCA  CACCGCCACG  CCGGGCCAGA
112441  CGCCGGATGG  CCGGCTTGGT  GATGCCCTGG  ATGTTGTCAC  GCAACACCTT  GCGGTGGCGC
112501  TTGGCACCCC  CCTTACCCAA  ACCCTTCCCG  CCCTTACCAC  GTCCAGACAT  GACTTCCCAA
112561  GAAGTGAACC  AAGAGCAAGT  GAGAGAATAG  GAAACCGATC  TTTATATATC  TACGTTACCC
112621  CTGCCCCCAC  CTCCAGCGGA  CACTGAGACT  GAAAAGCGCG  CAGGCGGGAA  ATGTGACGCC
112681  TACAGTCCGC  TCCTTTAACC  CCTCCTCCAA  GCCCCAGGAA  ATGGCGGGAG  CAGCGATTGG
112741  GGGAGGGTGG  GGAGATGAGG  GTGGGACCAA  GCAGGCTTGA  CCAATGGCCT  TTATTTTCTT
112801  AACAGAGCTA  CAGGCTTTGA  GGAACTGGGT  TAAGAATTAA  ATGTAAACCC  ATTCTGACTC
112861  CAGAATTATT  TTAAGTCGAA  CTTTTTTTTT  AACCGAATCT  CTCTGTCGCC  CAGACTGGAG
112921  TACATTAGAG  CCATCTCGAT  TCACTGAAAC  CTCTGCCTCT  CAGGTTCAAG  TGTTTCTCCT
112981  GCCTCAGCCT  TCAGAGTGTA  GCTGGGATTA  CAAGCGCTCG  CCGTCGCGCC  CGGCGTGTTT
113041  TTGTATTTTT  CGTAGAGACG  GGATTCGGCC  ATGTTGGCCA  GGCTGATCCC  GAACTCCTGA
113101  TTTCTGGTAA  TCCGCCCGCC  TCAGCCTCTC  AAAGTGCTTG  AATTACAGGC  GTGAGTCACC
113161  GCGACCGGCC  GAAATCGATT  GGTTTTGAAG  CCTTCAGTAG  CATTAAAACG  AAAAGTGCTC
113221  CCAATGCATT  CCCTTTTGTC  TTAAATTGGT  TTCTTACAGC  TACTTTACTT  GAAAAGGTGG
```

```
113281 TGGCTCTGAA AAGAGCCTTT GCTTGGACCG TCAGAGAGAC CACAGTAATC ACGCCCTCTC
113341 TCCGCGGATG CGGCGGGCGA GCTGGATGTC CTTGGGCATG ATAGTGACGC GCTTGGCGTG
113401 GATGGCGCAC AGGTTAGTGT CCTCAAATAG CCCTACCAAG TAGGCCTCGC ACGCCTCCTG
113461 CAGAGCCATC ACAGCGGAGC TCTGGAAACG CAGGTCTGTT TTAAAGTCCT GCGCAATCTC
113521 GCGCACCAGG CGCTGGAAAG GTAGTTTACG AATAAGCAGT TCAGTGGACT TCTGATAACG
113581 GCGGATCTCG CGCAGAGCCA CGGTGCCCGG CCGGTAGCGG TGGGGCTTTT TCACGCCGCC
113641 GGTGGCCGGA GCGCTTTTGC GGGCTGCCTT AGTGGCCAAC TGTTTGCGTG GCGCCTTGCC
113701 ACCAGTAGAC TTCCGAGCAG TTTGCTTAGT GCGAGCCATG ACGGAAAAAC AGCACAGCGG
113761 AACACCCAAC ACTAGCGCAA ATACGCCCAT GAGCTGCTCT ATTTATAGTG TGTAAAGTGC
113821 AGTGATTGGA TGATAGAAGA CGCTAAATAT GACGTTACAC ACTCTGATTG GTCTATCTTT
113881 AAGCCAGCAA CAATCGTGCA GTTTCACCGG CTACTATATT CTATTCCAAC TCTACAGATG
113941 ATTATTTAAG TGGTATTTTA TTACTACTAT TATTTATTT TACTTTTGCT TTGTTCCCCA
114001 AGCTGGTCTT AAACTTGGGC TCAAAGGATC TTCCCGCCTC AGCATCCAGA GTAGCTGGGA
114061 TTACAGGGGA GCCCCACTGC GCCGGCTTGG ACTTTAATTT TTTAAACTTG TCCTCTTCTA
114121 CATCTGGTTT TCATAACCTG AAGGCTGTGT TTATTTTCCA TAAAACAAGG CATTGATTCC
114181 AAAGGTATTA TAATTCCCCA ATTCCGTATA ACCTTCAGCT CTTTAGGAAA AAAAAAAAA
114241 AAAAAAAAAA GAGGGAATAC TGCTCACCTC CTCTCCGGAA ATGTACCCTT TACGGGAATT
114301 TCTGAAACCT TTCACAAGAA TTGGATTCCT TTGTAATGCT TTAATTGACT TAGGAGTGTT
114361 ATTGAAATCT ACAAAGCATC TCAAACATAG TAGGATTACA CTATTACTCA GAAACATTTT
114421 CTATGAGACG TCTTTCTCTT GATTATGCTC TTTGAATCCT AAACTTGCAG CGTTCTGCAG
114481 CTTTTGTTTT CTAAAGCCTA GGTGTACTCT GCCAGTCACA AAATGGCGTT TCTCCAGCAC
114541 TGCCGCCAGG TACCACCAGC TGGGAGTTGT TCCTCTTGCG GAGCAGGAGG TGGACTTGGC
114601 CCAAGAGAAA CTGGATAGTG GTTCGCAAGG AACATAATTT AGCATTGCCA AGAGCTAATG
114661 CAATCATTTT GAAAATCTCA AAACACTGAA AAGTGGATTG TGACCTTTTT AAATTCACAA
114721 GAGACAGGCC ACATTCTATC TTTTGATTGG TTTAGGCTAT TTTCTTGAAC AGCCATTTAG
114781 AAAGCAGATC TATCATCCTT CATTTGCATG GAGCGTTCCC ATTTTATTTG AAACCAGTTT
114841 AACCCAATAG AAAAAAGGGA GGCAGAACCC ATTATTTAAA GTGGAAACTC CTGAATCAGA
114901 TAATTAGGAG TATTTCCTTT TCAAAGTTG CGTTTTTCA GATACCTCGC TTATTACACT
114961 AAGAAAGGTT TATATCTTTC ACAAAGGGTT TACTTACAAA AATCTTCCAA TTTTGTATAC
115021 CTGTGTTTCA TAACTGACTA GCCGTCAAAC CAAGATGTAG AGTTTCCAAC CGTTATTTTC
115081 CAAATTTTTA GAAATTACGT GAAATATTTG AATGCATGCC TTCTCAATAA AATGGGACGT
115141 AGGAAGCACT GGTGCAGAAG ATGGGTACAA TACTTATCTG GACCACTCC ATTATTTGGT
115201 TGGCACGTTG TTTGAACAAA AAGGGGAAAA GCTCAGGTTA CTTAGCATGG TTCGGACTTA
115261 TTTGAAAACT ACCACAGCAG GAGCGGAAAT AAGACCGCAT TACCTCACTC TCTGCTGTGC
115321 TGTGCTAGGG GGTTATCCAG AATAGGATTG TAGAAGTGGA TGTCGATTTA ATAGTTTTTT
115381 ATTCTCCCAT TAGCTGAGTC TCTGATTGGC AATGTGAGAT CGTTTAGCT TATTGATACT
115441 TTGAAATGCA CTTAACAGCC ACAAACAAGT TAAAGGGTTG TTACCATAAA ATCTTATCCC
115501 CAGGGTGTGC TTGCATTTAT CACCCGTGTT TGCTTTCACA CTAAGTGGAC TTAACTCCCC
115561 AGCAGAATGC CTGTCAGGGA ACCGGTTTCG TGGACCCAGC ATTTAACGCC TTTCGCAGGC
115621 TTGTGAGGCC CATAAATATT TGTTGAATAA AAGAATGAGT TGACCATGTC ATGGTGCGCT
115681 GATTGCGTGT GCTGACATGG AACACAGGTT GTAAACCTTA ATACCAATTT GGGGCATGTT
115741 GTATGGATGA AAAGGGCATT GGAAATTCCT GAAGTGCATC CCACATTGGA CTGTGGAAAT
115801 AAGTTGCAAG TGCAGAAACG TTTCCACACT TGCAGTTTGA GTATTAATTG CAGCGTTTGT
115861 GAATTCTGGT GTTGTCTACG ATTCATTCTT GTTTGACGTG AAAGGTATTC GCGAGACACA
115921 TCGCTCTAAA ACATTGCCAG AAAATGTAAT AGAGTTGATG ACAACTGGCC TAACACGGC
115981 CTAAAACTCG CACTTTTCTC TCCCTCCGCA ACTATTCAAA ACACTGTATT TTACATTTCT
116041 TGCAAATTAA AAACTAACAT CTCTGGCAAC GGACCTCTAA AAATTTCTAA TAAAACTCCT
116101 CGGATGCTTG TGGCACTGCA TTTGTAAACC GCCCCTCTC AACCTACTCC CTAAAAAGA
116161 GCTGCTTTTT GAGAGAGAAG CGGTACCCTC TGATGTTACT GGGCGGCAGT CTGCCTACAA
116221 TTTCCTTCAC AATGAGGCAA CCAGAGCGGC TTTTTCTGTG TGTTTGCTTG CGTTGAGGGG
116281 AGCAGGACCA TAGGCCCTAG AGGCCCCCAG CTGCCTTCTG AGACTGGGCG AAACCCTCGG
116341 CAGCGCGCAG GGGGCGCTAG GGCGCGAGGG GCGGGCACTG ACGGGCACCA ATCACGGCGC
116401 AGTCCCACCC TATAAATAGG CTGCGTTGGG GCCTTTTTTT CGCATCCTGC TTCGTCAGGT
116461 TTATACCACT TTATTTGGTG TGCTGTGTTA GTCACCATGT CTGAAACAGT GCCTCCCGCC
```

```
116521 CCCGCCGCTT CTGCTGCTCC TGAGAAACCT TTAGCTGGCA AGAAGGCAAA GAAACCTGCT
116581 AAGGCTGCAG CAGCCTCCAA GAAAAAACCC GCTGGCCCTT CCGTGTCAGA GCTGATCGTG
116641 CAGGCTGCTT CCTCCTCTAA GGAGCGTGGT GGTGTGTCGT TGGCAGCTCT TAAAAAGGCG
116701 CTGGCGGCCG CAGGCTACGA CGTGGAGAAG AACAACAGCC GCATTAAGCT GGGCATTAAG
116761 AGCCTGGTAA GCAAGGGAAC GTTGGTGCAG ACAAAGGGTA CCGGAGCCTC GGGTTCCTTC
116821 AAGCTCAACA AGAAGGCGTC CTCCGTGGAA ACCAAGCCCG GCGCCTCAAA GGTGGCTACA
116881 AAAACTAAGG CAACGGGTGC ATCTAAAAAG CTCAAAAAGG CCACGGGGGC TAGCAAAAAG
116941 AGCGTCAAGA CTCCGAAAAA GGCTAAAAAG CCTGCGGCAA CAAGGAAATC CTCCAAGAAT
117001 CCAAAAAAAC CCAAAACTGT AAAGCCCAAG AAAGTAGCTA AAAGCCCTGC TAAAGCTAAG
117061 GCTGTAAAAC CCAAGGCGGC CAAGGCTAGG GTGACGAAGC CAAAGACTGC CAAACCCAAG
117121 AAAGCGGCAC CCAAGAAAAA GTAAATTCAG TTAGAAGTTT CTTCTAGTAA CCCAACGGCT
117181 CTTTTAAGAG CCACCTACGC ATTTCAGGAA AAGAGCTGTA GTACACAGAT GAAATCCCCC
117241 AAGCAAATGC AACACGCCCT CAATTATATT AGAATCACTT GGAGAGTCGA TAGAACTTTA
117301 ACATAGCCTC ATCTAGTAAG AATTTACTAC TCAATCTATC AAAGATAGCA AGGTGAATTC
117361 AAATGCACCG AGTTAAAATC GAGTTTTAAA GTCACCTGGG TTTCGGTAGC CGGAAGTCCC
117421 GCGTCTCACG ACTCCAAGCT AATTAGTCAT AACCGTATTG AACCAAGGTT GAAGCCCAGT
117481 CCCAGGCTTG AGGCTTTTTA TTATACAAGG TTAAAGTGGG GATATTGCGT TTTGGGGTCA
117541 ATATTGCTAA AGTAGCATTT TCCGAAATTG GGTGGTCCTA AGAAATGCTT CTGGGATAGT
117601 TGGCAAAATA TATGGCTTAA CCACGCCCTC TCCACAGGAG TGGCTAGCGA GCTGTCTGTC
117661 CTTGGGAAGG ACGGTGACCC TGCTGGCGTG GCTGGCGCCC ACGTTGGCGT CCTCTGAAAG
117721 CCCCGCCAGG TAGGCCTAGC TCGCTTGCTT TCTGCAGCGC CATCATGACA AAGCTTTGAA
117781 ACGCAAAATG CTTTCTTTGT GCAGCGCCTT ACCATGGGTG CACTTACGGG CTGTCGACTT
117841 GGTTTAGGCC CTTGTCAGGA CAAAGGAGCT TAGTTTGTTG GAGTTTTAGA GCTGCAACCC
117901 AAAATCCCTT GCTCGGTTTC TCTGTTTTTA GAAACGGAAG CGCCCTGATT GGATATTTGA
117961 AAATTACTGT GCTTAACTGG ATCGTGTTTC ATCAGTCGTG CAGGATTTTC AACCCTGGTG
118021 GAGCCCACAC ATTCAAAACT GAAGATCCTT TTCTCAGAAC TGCCCCTTTA AGCTTTTGCA
118081 ATTTTAATTC TGGGGGTCAG ATTTTAATAA TTGGACTTTT TTGTTTACAT CTGACAAGAG
118141 TATATGATGA GCCAAGTTTA CTCACTTTTA CTTAGTGCAG TTCAATTCTA AAAGTTTATT
118201 TTTGCGTGTG TGCATATGAG TTAATAATCA GTTGTATTTT TCAAACGGTC TTTTTTCAAT
118261 TGTTTTGCTT AGCTCCTTCC ATCGTCTAAA GTCAGGGATA CAGGCACATC ACATCCCTGT
118321 TCCCCCTTCC TCAAACTAAT ATGTAGCTAC CTAGGTTTAT CCTTTAAAAC AAAAATTCTC
118381 ACCTATTTTT GTGAGAAATA TACATGTTTT TCTTTGAACT AAGTATTTTA CATACACCTA
118441 TCTATATACA TGCATACTTG TGGTTTTGTT TTTTTAAAAA AAAAAAAAAA AAAACACGTT
118501 ATCTTTTGAG ACTGGGTCTC AGTCTGTTGC CCAGACTGGA CTGCAGTGGC ATAATCACAG
118561 CACACTGTAA CCTCCAACTC CTGGGCTCAG GCTATCCTGC AGCCTCAGCA TCCGGAGTAG
118621 CTGGGATTGC ATGCACGCAC CACCAAGCCG GCTTTTTGT TTTTATTTTT TGTGGAGACA
118681 GTCACACCAT GTTGTCCAAG CTGGTCTAGA AATGGCCTCA AGTGATCATC GACCTCCCAA
118741 AGTGTTGGGA TTACGGTCAC TGTGCCTGGC CTTGTATGCA TAATTGTTTT GTCTTTTGAT
118801 TAGGGTTATT AATTTAAAAA ACAAAGCCTG GACGCAGTGG CTCACATCTG TAATCCCAGC
118861 ACTTTAGGAA GCCAGATGGG CAGATTACTT GAGCTCAGGA GTTCAAGACC AGCCTGGGCA
118921 ACATGGTGAA ATCCCATCTT GACAAAAAAT ACAAAAAATT AGCAAGGCCC AGTGGCACGC
118981 ACTTATAGTC CCAGCTACTT GGGAGGCTGG GGTGGGAAGA TGACTGGAAC CTGGGAGGTA
119041 GAGGCTGCAG TGAGCAGAGA TCGTGCCACT GCACTCAAGC CTAGGTGACA GAATGAGACC
119101 CAGTCTCAAA ACAAAAATAA TAAAAATTTT TTACAACGAT GTTATATACA CTTCTGCATG
119161 TTGCTTTTCT CTTAACCAAA CTTTTCTAAA ACCCTGTCAT GAAAAAGAA ATCCTTCACA
119221 TGGAATAGCA TAAGTTATTC ATCCATTTCT TATTGATAAG CATTGATGTT TCCAGTTACC
119281 ACTGCTGAAC ATGGTGCAAT TGAATAGAAT TCCAGGGCTG AGATTGCTAG GTTTTAGGTT
119341 GTATTTTATT ATTTTATTTA TTTATTTATT TATTTAGACA GAGTCTTACT CTGTCACCCA
119401 TGGTGGAGTA CAGTGCCATG ACCTCAGTTG CAACCTTTGC CTCCTGAGTT CAAGCGATTC
119461 TCATGCCTCT GGTCTCCCGA GTAGCTGGGA TTACAGGCAC TGCCACCAG GCCTGGCTAA
119521 TTTTTGTATT TTTAGGAGAG ATGGGGTTTC ACCATGTTGG CCAGACTGGT CTCAAACTCC
119581 TGGCCTCAAG TGATCTGGCC ACCTCGGCCT CCCGAAGTGC TGGGATTACA GGTGTGAGCC
119641 ATGGCGCCAG ACCTGGACTT TGTCTTCTGT TTCATCAGTC CTTCTGTTGG TTCAAGCACA
119701 GTATCACACT GAAGACTGAT GATTCTATAT AAATATGGTA AAGACTGTAC ACCCTAACTG
```

Figure 1 (Page 37 of 73)

```
119761  TTCTTATTTT  TTAATTTTAA  GGCAATTTTA  GATTCCAGCT  TTCCAAAGAA  TTGTGGAATG
119821  CTTAGAGCTA  GAGAAGCCTT  GGAAGTCATT  TAGTTTTTGT  TTTGTCAGAG  AAAATTCTGT
119881  AGAGACTCTG  TCCTGCTCTC  ACTGAATACC  ATCCCATAGT  ACCCCCCAAC  AGCTTTAAAG
119941  GGCAATAATA  CCTTATGGAC  AGTATGCTTT  TCCTCAAATA  TATTCTAAGC  CATGGTCAAT
120001  GCAAAAGAGT  GAGAAGGAAA  GTAGAATAAG  TTATCTAAGA  ATCAGTGGGT  GCTCTCTTTA
120061  AACTGATTTA  TCACTCCCCC  TTCCAAACTC  TCTTGAAGGT  CACTCTGCCT  CCCTTTCTAC
120121  ATAAGAACTC  CTAACTCCAA  GGGAGGAAGG  TAAGTTATTC  TTATTCCTTG  CTTAGAAAAA
120181  GAGAAAATAG  GTTTGGTAAG  CATCCGCTTT  CTGCTACCAT  TCTCTGTGTT  TCTGTGTTTT
120241  TTATAGGATC  ATTCAATTAT  TGGTTGGCTC  TTGAGAGGGA  ATGCAAGGTT  CAAGGACACA
120301  AGCCTAGATC  TTGCCTGTAT  AGAACCTCAT  GATGTTATGC  TTCTCTAAAA  TGAGGCCTGG
120361  AGGAGACATG  TTGAAAGTGA  CCCATAAATC  TGCAGTATCT  CATGTCTCTC  AATGGGGACA
120421  AGGAGTACCA  TGGGAAATAG  CATTAGGTCA  ATGACAGTAA  CAACTCCAG   GTGAGTTGAT
120481  TTATTCTTTT  ATTTATAAAG  TTGTTAATAT  GCTACATAGT  CCCTAATTTT  GCCACAAATA
120541  GTCATTATTT  TAATTTCATA  TTTCACTATT  GATAAATGAA  GGAAAAAATG  AGTAGCAGTT
120601  AAGCAGTCCA  TAAACCTACA  TATAAAGCAA  ATTGGAGATT  TTAAAATTGA  TTCTGGATGC
120661  TTAAAATCCT  TCTCATTGAA  AAAAAATTTC  GTATTAGAAG  ATTTCAACAT  TCTTTAAACT
120721  GAGAAGCATA  ACATATAAAC  AGAAAACCAC  AGCAAAACAA  AAATGCAAAG  CTCAATAAAT
120781  GAACACAAAG  TGAACACCAT  AATAATTGCC  ACACAAGTAA  AAAAACAGAA  AATCAGCCAA
120841  CCCTCCCAGA  GCCGCCTGAT  GCTTGCTTCC  AGTCACATTA  TCACTCCATC  TGCCCTAAAC
120901  ATAACCCCTA  TTTTGATTTC  CAATGCTGTA  ATTTAGTATG  CCTGTTTTTG  AAACATATAA
120961  AATGGAAATA  AACAAATGT   AATCCTATGT  ACCTGACATA  TTTCACTCCA  GAACATTAGG
121021  TTTGAATAGA  TTCATCTGTG  TTGCTGTGTA  TAACTTTAAT  TCATTTTAT   TGTTATGTAA
121081  TATTCCATGT  TATGAGTGCA  ACAATTAGG   TGTCTACTGT  TGATGCATAT  TTGCTTCCCT
121141  TTTTCAGCTA  ATATAAACAA  TACCGTGAAT  ATTCCTGTGT  ATGTGTCTTG  GTATATATAG
121201  GAATACATAT  TTTGTTTGTA  TACCTAGGAG  AGGAATTGTT  GGGTCAAATG  CTAAACTCTT
121261  TTTGAAAGTG  GTGATATTAG  GTTTACATGC  GATGAAATGA  AAATTAAAAC  CACAGTTATA
121321  AACAGCATGG  ATGAACCTCA  CAAACCTAAT  GTTGATGGAA  TCTAGCTGGG  AATTCCTGTT
121381  CTTCCATATA  CTTCCCAATA  TTTTTTTCCA  ATTAAAATTG  TTAATCTTTT  GAAGATGTTA
121441  TCCATTGTGG  CAGATGTGCA  GTATTATCTC  ATTATGGTTT  TATTTTACAT  CTTTTGCCCA
121501  TTTTTTCTTA  ATTGGATTGT  ATATCAGTCG  ACTTGGGCTG  CCATAACAAA  AATACTAGAC
121561  TAGGTAGCTT  GAACAAAAGG  AGTTTATTAC  CTCACAGTTC  TAAAGGCCAG  GCCAGAAATC
121621  CTAAATTGAG  GTGCCAAGAG  ATTCAGTTTC  TAGTGAGGGC  TCTCTTATTG  ACCTGAAGAT
121681  AGTTGCTGTC  TTAGATTGTT  TGGTGCTGAA  CAGAATACCA  GAGACCAAAT  AATTTATAAA
121741  GAATACAGAT  TTATTTCTTA  CAATTCTGGT  GGCTATAAAG  CCTATGGTCG  AGGGGCCCAC
121801  CTCTGGCAAG  GGCCTTCTTA  CTGTTATGGC  AGATGTGAGA  TGTCATCTCA  TATTCAAACC
121861  ACAGCAGTCG  CCTTTTGTGT  CCTCATGTGG  CCTCTTCATA  TGCCCATAAA  ATGACCTCAT
121921  GTCTCTTCCT  TTTCTTATAA  GGACACCAGA  TCTATCAGAC  TACTGGCCTA  CTCTTATGAC
121981  CTCATTTAAC  CTTAAATATC  TCCATAAAGT  CCCAAAATCC  CTATCTCCAA  ATATAGGCAC
122041  ATTGGGTGTT  AGAGTTTCAA  CATCAATTTT  GGGGAACAC   AATTTAGGCC  AAAAAGATTG
122101  TGTTTTTTCT  TGTTGGTTTA  AGATAGCTGT  CTTTTTGTCC  TTTTTGTCCT  TTCTTTTTTT
122161  TTGAGGTGGA  CTCTTGCTGT  GTCACCCGGG  TTGGAGTGCA  GTGGCGCTGT  CTCAGCTCAC
122221  TGCAACCTCC  ACCTCCTGGG  TTCAAGAAAT  TCTCCTCCTC  CCAAGTAGCT  GGGACTACAG
122281  GTGCATACCA  CCGCGCCCTG  CTAATTTTG   TATTTTTGAT  AGAGACGGGG  TTTCACCATG
122341  TTGGCCAGGC  TGGTCTCAAA  CTCCTGACCT  CAGGTGATCC  ACCTGCCTCG  GCCTCCCAAA
122401  ATGCTGAGAT  TACAGGTGTG  AGCCACCAAA  CCTGGCCTGT  CTTTTCTGTT  TTAAGTTTTT
122461  AAATTTTGCT  CACGAACCCT  TTATCCATTT  TATGTGTTGC  AGGTATTTCC  TCTGTAACTT
122521  GTCTTCACTC  TGTCAGAGGC  TGGAGTGCAG  TGGCACAATC  ACAGCTCACT  GCAGCCTCCA
122581  CCTCCCAGGA  TCAAGCGATC  CTCCCATCTT  ATCCTCCTTA  GTAGGTGGGA  CTACATGTGC
122641  AGGCCACCAT  GCCCAGCTAA  TCTTTGTATT  TTTTGTAGA   GATGGTGCTT  TGCCCAAGT
122701  TGGTCTCAAA  CTCCTGAGCT  CAAGCAATCC  ATCAACCTTG  GCCTCCCAAA  GTGTTGGGAC
122761  TAGAGGTGTG  AGCCACCACT  GCACCCAGCC  AATGATATCT  CATGATGCAT  TAAAGTCATT
122821  AATTTAGTGT  ACTCAAATTA  AGCACACTGC  CCTTTTATGC  ACAACCTTTT  TTGTATCTTA
122881  TTTAAAAAAT  CATTTTCTAT  TTCAAGGTCA  TGAAGATCTT  ATTTTATAAT  ACCTTCTTGT
122941  GAAATTAGTT  CTCAAGACTA  CCCTCACTTC  TAACACCAAT  TATAAGTTGG  GAGGTCTGTG
```

Figure 1 (Page 38 of 73)

```
123001 GTTCCCAATC AACCTTAGGT TAGTAATTTG CTAAAAGGAC TCACAGAACT TGCTGAAGCT
123061 GTTAGCCTCA TGGTTACAAT TTATTATAGG ATATATAGCT TATTATGTCA TTCCAATGCA
123121 ATGTAAAATT ATACAACTAC TTTTAAAAAG ATTTTAGCAT TTGACCCAAC AATTTCACTC
123181 TGAGGTATAC AAACAGCAGA TATGTGTGCA CATATATACC AAGACACATA CACAGCAAAA
123241 TTCATTGTTT GTAATAGTTG AAAAGGGGAA ACAACTCAAG GAATAAAGAT TAAAATCAGC
123301 TGAGAAAAGA AACACACAAG GCAGTATTAT GGATCGAATT GTATGCAGAT CTCCCTTGCC
123361 CCCAGAAGAT ATGTTTAAAG TCCCAACTCC CAGTACCTCA GAATTGTGGC CTTATTTGGA
123421 AATAGGATAG TTGCAGATAT AATTAGTTAA GATGAGGTTA TAGTACAGTA TGATGGGCTG
123481 GTGACTTAGA AGAAGTAGTA TATATATATT TTTTAATAGA ACTAGTATTC TTCTAAGGTG
123541 GTCACGTGAA GACAGACACA CACAGGCAGA GACTGAGGTT ATGCAGCTGC AGGTCAAGGA
123601 ATGTCAAAGG TTGCCAGCAA GTACGAGAAG CTAGGAAGAG TCAAGGAAGG ATTTTCCTAC
123661 AGGCTTCAGT GGAAGCATAG ATCTAATGAT ACCTTCATGT CAGATTTCTA GCTTCCAGAA
123721 CTACAAGAGA ATATATTTGT TGTTTTAAGC CACCCTAGCT TCTAGCTCTT TGTTACAGCA
123781 GCCCTAGGAA ACTAATATAG GCACAATCCA GGCAAGTTCC AAATATGAGC TTCCAGTTGT
123841 CCTCTCCCAG TAATATGAAC AGTATTACTT TCCCAGCATT AATGTGTGAC AATACACATG
123901 ACGTACAGAG CAGTCCCCAC TTATGCACAA AACATATGTT CCAGGACCTC CAGTGGATGT
123961 CTGAAACCAT GGATAGTACT GAACTCTATA TAGCTGTTTT TTCCTATACA GACACAGCTA
124021 TGATAAGGCT TAATTTATAA ATTAGGCACA GTAAGAGATT AATAACAATA AATTAGAATA
124081 ATTGTTAAGA ATATACTGTA TAAAAGTTAG GTGAATGTTT ATTTCTGAAA TTTACCGTTT
124141 ATTATTTTTG GACTGCAGTA GACCACAGGA ACTAAAACCA TGTAGAAACC GTATACAAGA
124201 GAACTGTATT TCACCCGAGC CTCAGTGTGC AGTTTAATG GCCTGCCATG GTTGACTGCT
124261 CACATGGCCG ATCTTTTAGT CTACCTCCAC AGGTAGAGCT GATACTGTGT GGCTCAAAGT
124321 TCCTATTATA AATCACATTG TTGACTGTGT GGTGGTCAAA ACCTCCAGGT AAACAAAGAC
124381 ACACTTATCA GTGAGAACAT TTCAAGGGTC TAAAATTCAT CTCCCAGTAG CTGAGGGCAA
124441 AGGCTAGACC TCTTTTTGGG TAAGATAAAT TTTTTACCAT ATACTTTATT TTGCTTTTCA
124501 TGTTTAACTT TATTTTGCTT TTCATGTTAG TTCCCCTGGA ATTGTTTTTT GTGTATAGTG
124561 TGAAGTAGGG GGTCAAGTTT CTTTTTTTTT CCTTTTTGTT CTTTTTCTGT TTAAAAGGCT
124621 ATACAATTGT CCCATGCCAT TTATTTACAA GAGTCCTTTC ACCATTGTTG TATGGTGCCA
124681 CTTTAGATGT AAATCAATGT CCATATTTGT TTGAGCCTGT TCCATTCGTT TGTCTATTTT
124741 TGGACAACAC TGCCCTGATT ATTGTCATTT TATCAGTTTT GATATTTAAT AAAGCAACAG
124801 ATTTGTTTAT TTTGGGCCCT TGGATTTGTG TATTAAATTT GAACCCTGTT TGTCAATTTC
124861 TATAATAAAG CTTATTGGGA ATCTGATTAG GATTACAATG GTTTTGTAGA TCAGTTTGGG
124921 GACAATTAAT ACCTTTAAAA TATTGACCGC TTCAACTGTA AATATACTCC TCCATTATTT
124981 AGTTTTCCTG TTTAATTTAT CTGAGTAATA CATTATAGTT TTCTTCGTAG AAGTCAGATA
125041 CGTAGAAAAT TCAAAGCCCA AGTGCAATAG CTCATGTCTG TAATACCAGC ACTTTGGGAG
125101 GCCGATGTGG GTGGATCACC TGAGGTCAGG AGTTTGAGAC CAGACTGGCC AACATGGTGA
125161 AACCTCATCT CTAGTAAAAA TACAAAAATT AGCTGGGTGT GGTGGCGGGC ACCTGTAATC
125221 CCAGCTAATC AGGAGACTGA GGCAGGAGAA TCGCTTGAAC CCAGGAGGCA GAGGTTGCAG
125281 TGAGCCAAGT TCCTGTCACT GCACCCCACC CTGGGCGACA GAGCGAGACT TCGTCTCAAA
125341 AAAACAAAAA AAAGAACATT CAAATAATCA ATGTAGATAA TTCAAATAAC TAAAAAATGA
125401 ACAGTTATTA AAATATCAGG ATATAAAAGC AAAAAAATCA ATAACCTCCA TATATACAAA
125461 ATGGCCAGTT AGAGAAAAAA AAAAGAATAG GCGAGACTTA AAAAGGCTGG GAATCTCCCT
125521 GAAAATCTTT GAGAGCCTTG GCCCTGCCCT CAGGGATTTC TCTGGCTTCA TGCCCAGATA
125581 CGGGTACAGT TCCTTGTTTA AAAAAATTTT GCTCCATCAA TCAACAAGGG GCTCCTTCCT
125641 CAGAGCACAA GGACCTCCAT AACACCGGAC ACTAGATGTC TAAGGGACAC CTCTTAAGGA
125701 AGTTAGACTT CCAAAGAATG GTGTTTCCTC TGTCCCCAAA CTCTGGAACT CACAGCACAA
125761 CTGCTCCTTG GAGTTCGGTT TCAAATCTAC AAGGCTGTCA TGGAGGTTGC AGACCAAGTC
125821 CGTGGCCTCA GTGTCCGGAT GTACGGTGGC CTTGGCACCT GAATGTGAGA ACATGACCTC
125881 CCTGAAACCA CCACAAGTAT TGTTTCATGT TATGTATGTT TTTCTTATC TGAAATTCCT
125941 TTTCTTTAAA AATTCAAATT ACATATTTTG CAAGCCCCTG AACAAGCTTC ATGAGCATTT
126001 ATTGAACCCA CAGCTTTTAA AACCTACTGA ACACTTTGCT CTATGTTGTC ATTCACTATC
126061 CACCAATTAT TTAATTATTG ATCAATATTG TTTCCTTAGT GTTGGGATCA TTTATGCATG
126121 TATTTCTTTT ATATTGCATA TTTTATATTT CTGCATTACA GTTATTACAT ATTACTTTTG
126181 CTACAGTAAT AGTTCAAAAG TGTACATCCA AAATTTAGCT GTGAAGTGGA TGGACTGAGG
```

Figure 1

```
126241 CAGAACTGGA GGCAAGAAAA TGTCACAGTA ATTCTAAAAA AGATGATGTA CAATTAGAGC
126301 AAGAGAGTAG CACTGAAATT GAAGAAAAAT AGATGCGTTT GAGAGAAAAT TAGGAGGTAG
126361 AATCAACAGA TTAGATGTAG GGATGAGAAG GGTCAAAGAT GACACTAGGG TTTTTAACTG
126421 GAGCAAGTAG GTAGACAGAA CATTTCTTCC TGAAAGGGCA GGTCAGATCA TGTGTTGTCT
126481 CAAAGGGCAT GAAGAGTAGA AAGCCTGGGA CAGATCCTGA GATGACCAAT ACCCATGGTG
126541 CAGGGAGAGG GAGGGAGATC TGCTAAAAAG ACTGCAAATG TCAGGATAGT AGAAAATCAT
126601 GAGTGTGTGA TGTCCTGGAA GTTGAGACAG TATCACATTT GAGAACATTT AAATTGGTAA
126661 CTCTGACAAA AAGCTGGAGG CCAACTGTGA ATGCCCATGA GAGTGAGAAG CTCCCACACT
126721 TTTGTGGGCA TCAGAAAGCC CACCAGGTTC CTGCAGTGAA GATCTGAGAA GGATCCTCTT
126781 GTGGCTTTGG CAGGGAGAGA AGAATTATTA TGAAATACAC CCCAGAACCT TCTTCAAAAC
126841 AAAGGCCTAC TCTCAAGGGG AAAACATTTT GCCAGAGTCT TATCCCAGCT GGGAGAAGGT
126901 AATTCTTCCC ACTGCAGCCT CATCTAGGCT TTCTGTCTCA CTTAAGGGAA GAAAATTAGT
126961 CAACAGGGAT CAGAGCTTCA TGAAAATAAA TTGGAAATGG TGCAGCCAGG AAAGGAGCAA
127021 AGGTCTGAGG AGGAGGAGAA GGAGGAAGAG GAGTTGTATC ATTATAAATA CTTGAGGAAG
127081 AGGAGGAGAA GGAGGAGGAG GAGGAGTTGT ATCATTATAA ACACTTGAGG AAGAGGAGGA
127141 GGAGAAGGAG GAGGAGGAGT TGTATCATTA TAAACACTTG AGGAAGAGGA GGAGGAGAAG
127201 GAGGAGGAGG AGGAGTTGTA TCATTATAAA CACTTGTGAC GGTCCCAGCC CAAGATATA
127261 GGCATGCTAA TAAACTGAGG CTTAACACTT TGACTACAGA ATGCTGCTTC TCCCTAACAC
127321 CATCAAGGCT CCAACTGAAT AACAATGAAT TATGAATGAA AGAGCTGTAA GGAGAGACAA
127381 AAGTTAGAAT GAGACAAGTA TTGTTATCTA GAGATGCCAA GAAGGCAAGG AAGATAACTA
127441 AAAAGGCACT CTGGATTTAG AAATAGGAAG TCATTAGTGA CCTTGTAAAT AATGGAGCCA
127501 GAGGAATACC AAGGGCAGAA GCCTCACTAT AGTGTGTTGC ACCTGTCAGA GGTCAGGAGG
127561 TGTAACTGAC TCTCCCACAG TGTGGCTTTG GAAGAGAGAA GTCAGCAGCT GCATGGAGAT
127621 TTGGGAGAGG GAAAGCTTTT TTTTTTTTTT TTTAATTGGA AAAGACTGAG CTATGTGTAA
127681 ATAGAATAAG ACAGGAAGAG TGTAGACACA GGAAAGAGGG CAGACAAAAA CAAGTGCACA
127741 GTTATCTAAG GGAAACAATG GGATCAAGCT GCAAGTATAT AAACTTGTCT TGATAGAAGA
127801 ATCCTTGATC TGGTTTATTC AGTGTTTGGT CCAAACCCAC ATCCCTGTTC TGCCTGTCTC
127861 TGACTTGCTC TGTGCCCCAG AAGCCCAGCT TCTACAGATA GCATTAGCTG GGCAGCCCTG
127921 CCCTCTTGCA ACAGCTGGAT TTGGCCAGTG ATCAGCCCAG CAGGAATGTA GATGGCAAAG
127981 GAGAGAGAGG TTAGTGTACT TATTCCCTGC ATCACCCCCC TGCTTGGTGG GCAGCTCTTC
128041 CTCCACAGTC CCAGCTCTGG CCTAGCTCTG GTTACAGGTT CCCTCCCATT GCCTCTTCAG
128101 ATTTAAAGGT GTGTCTGTCA GGGTATAACT GGGAGCTAGA AATTGCACTG AAATTGAACA
128161 AAGAATTTTA TGGGAATGGT TGTTAACTAG TTATAAGAGG ACTGAAAATG GAAAAGTGGA
128221 CAAACGTATC AGAGATAGTA ATGACAGAAA GCAACTACCA CCTCCAGGTT TAGGAGAACA
128281 AGGAAAAGAT TCTTTGAAGA GATCCCCAGA ACTGGGACCT CTGAGGAGTG TATGCTGGAC
128341 CACTGATGAT GATATGTCTG TAGATAGAGG CATGATGAGG CTGATTTTAG GAGCATGGAA
128401 GATCTCCAAA CTGAAGCCAA CTGCTGTTAC TGGATTCAAC TGCCACTGCC AGGTTGAAGA
128461 ACCCATTCTG TGAGGATGTC AACAAACAAA GTGGGAAATC TTTTCACATC CTTCCAGCCC
128521 TCTAGTCTTC CTCCAGTGCT TTCTATTGGT AGGGTTTGGG GAGGTGGCTA GCAAAGCGGT
128581 ATTGGAAAAG ATAGAAGAGA CTAAATCTTC ATAACCAGCA CAGGGTGACA CTGGATCACT
128641 ACTGTTGCTG ATCTTGGGCT GCCTCATATC CCCTGTTCTT CCCATTAGCC CTGTCACAAC
128701 TTTGTAGATA TCCCTTCATT ATATGCCCTT CATATATTCT TTTGGTTTAA CTTTTTCTGT
128761 TGGAATCCTA ATATGGCACT CCTCCATTTT TCAGGACCAA AAGAGTATAA AAGATTATCT
128821 TTTACCAAAA AAAAGACAAA AAACTGATCT AATTCCTGAT TTGATCATTA CACAATCTAT
128881 ACATGTATCA AAATATCACA TAGTACCCCA TAAATATATA CAACTGTGTC CATTAAAAAT
128941 AAAAATTAAA GAAAAGATGG TAAATATAGC TCTGTCAGGC AGTGGAGGTT TTACCACGAT
129001 GGCTGTTATT TCCCCCATGA AGGGGGGAGT GAGGGAGCAG CTGAAAGTAG GTGCTTATAG
129061 GGGTATAGAG GGGCTCAAAG CTTTGAGAGA GGAGAATGTC TGAAAGAGCT GCCAAATAGC
129121 ATGCAGGTCC CATGGGGGCA GAGCCTCTGC TCATTCACCA GTGCCTCTTC AATATCTACA
129181 CTTAAGCCTA ACACAAAGTG TGTGCTTAAT AAGTATTTGC TGAGTATGTA AAGTGGAAAC
129241 AGAACCAATC TGGCAAACTT TGTAGGACTG GTGGGCAATG AAGATCAGTC AGGTAAAATC
129301 TGTGGATATA AATTTATATT GATCAAAAAA TTCAAGGTTA GGTGTTTTTC TTCAGTCATG
129361 CTCAACGATG CTTCAGCCAT GCTCAACTCT TCTGTAGCCA CAGAAAAAAG TTTACCCATA
129421 ATCGAGCTGT GTCTGTGTCT GAATAATGAA AAGACCATGA TGCAAGGGAG TTGGAGACAC
```

```
129481  AGAAACAGTG TTTGAAGTAA TGGGTAATGG AAGCATGCTA CCAGGGAAAG GAAAGAAGTG
129541  GCAATAGGAA GGAACAGAGA TCTGTGGTCC TATGTCCCCT GAGCATATTC ACATGTTAAA
129601  GCTAATTCAG TTTTCAATCA TCATTAAAAT TTTGTTCCTA AATATATGGC CATTATTTTC
129661  CACAACCACA CTAAAACTTT ATTACCTCTG GCAAGTGACT ATGCAAGTAA CTAAGAGCAA
129721  AAATATCCAC AACTACCATT TGAGCTATCA ATTTAGGGAA AGTCATCTGG CTATAATCTA
129781  AGTGACCCTC CACTGAATGT CAGTATCTTT GCATATGTGA TTTAAATCTG GGCCTTCGCA
129841  ACACCATGAA CTGTTCTTGT CTTGAATATC CAGATTGAAG GAAATAATCT GAGTAGTTAC
129901  GAGTCCTGAA GCTAGAAAGA TGGAAACCCC ATTTGCTCAT CAGAAAGCCT TAGAGCTTGG
129961  GCGCTGGCGG GTCCTGTCTC ACCGGGACAG AGGGGCTCTT TCCTCCCCAT CTGATAGTCT
130021  GATAACTAGA GAAGCCGGCC AACTTATTCT CCAAGAAGGA GCCATCTTAG TTCCTCCTGA
130081  AATGTTCATA TTTAGAAATT ATTGTTTGTC AGTAATTTAA CCCCTTAATG GGCTTGCCTT
130141  GTGGTCCATA CCACTGAGTG CAGAGCTTGC CTGGAAGAAT TGTGAGGGCC ATTCCATCTT
130201  CCAGGCAGTA GAGTTCAGTA CTTCTTTAAA ATTGCTGCTG AACTCTGTAT TTGAAAAGAA
130261  AGAATCATTT GGGTGTGGTA GCTCACACCT GTAATCCTAG CGCTTTGGGA GGCTGAGGTG
130321  GGAGGATCAT TTGATGCCAG GAGGACCACT TGAGACCACC CTGGGTAACA TAGCAAGACC
130381  CTGTCTTTAG AAAAAAAAAA TACAATAAAA TAAATACAAT AAAAATAAAA GCAAAAGAA
130441  AGAGTCCATC TTAGGGACAG ACTGTAACTA CTCACTGGAG CTTACCTTTA CATAGTTCAG
130501  GATCAATTAT AATAAAACAC TTTTGTGCAG ATTCAATAGG ATTATTTTAA TCCCCATCAT
130561  CTCTCTGAGT TTCCAGTCAG TTTCTCTGCA TGTAGACACC CTTCTCCAGC CCACCATTGT
130621  CTCTCCTCCT ATAGCTCCAC CAACAAATCA GAACTTTTTC TAACTGCACC TAGTGCACCT
130681  AGAGTCTACT CCAGAATGCT CATGGAGAAA GTTTCTGAAA GGTAAAACTC TGAATGATAT
130741  TTGTAGCTAA AGGGAGACTT GCTAGAGACA ATAAGCTAAT AGTTGTAGAC TTCAGTAGAA
130801  GAGGAATGAC ACTGCAATGT CAGGGTGCAG GACTTCAAGA GGGCAGAGTA TGGAAACCCA
130861  ATGGGAAAAA TGCTCACCAG GAACATGAAG AGAAGGAATT ACGTGTAAGG ATTTCTCAAT
130921  GTGTTCCCAA ATTTGCCCAG CAGAGGGAGG CCTCGGGTTG ATGGCAGGCT GACCACACAA
130981  TTAAAGAAGG CTGAACCTGG GGGCTTTTAA CAACCATCGT GGGCTCTACT GTAAGCATTT
131041  AGAAAAAGAA AGTTATCCAT TCAAAAATAT ATATATTTTT AAACTTCAGA ACAAAATTAT
131101  GAAGAGCTAT ATTTACTTTT CTACATTCTA ATTTTTATAA ATCTGAGTAT ATTTTGCATA
131161  TATTGTTATA GTACATATTC AATTTTGTAT TTGCTGTTT TCACTTAACC ATTTTTACTA
131221  GATTACTCTG TGTTCATAAT AATCACTTTT TTAAAACTTT TATTTTTATT TATTTATTTT
131281  TTTTTTGAGT CAGAGTCACA CTCTGTCGCC CAGGCTGGAG TGCAGTGGCG TGATCTTGGC
131341  TTACTGCAAC TTCCACCTCC TGGATTCAAG CAGTTCTCCT GCCTTAGCCT CCTGAGCAGC
131401  TGGGATTACA GGTGTGCACC ACCAAGCCCG GCTAATTTTT GTATTTTTAG TAAAGACGGG
131461  GTTTCACCAT GTTGGTCAGG CTGGTCTCCA ACTCCTGACC TCATGATCTG CCCACCTTGG
131521  CCTCCCAAAG TGCTGGGATA ATCACTTTTT ATGCTGCATA ATTCTTCAGA TTTGTCAGTA
131581  CGACTGTATT TACACTCATT TGTTTTATTA GAAAGAATTC CAGAATATTT TGGCTGCCCT
131641  AATTAATTTT ACAATTAATA TGATTTTGAA ATTGGGTATT GGCTCCTTCT GAATTGGTTT
131701  ATTAAAATAT ATTCTAATGT AATTTATGAC ATTTTCATCA TATTAGCATA TTTATTCTGT
131761  TAGAATTTCA TAATTTATAA AGCTACAAAC TGTATGTGAT ATAGCTTGTA ACTTTATCTC
131821  ATAACTTTAT GCAGTTACAA GTAGAAATAA AATGTTCCCC TCAAGATTGC TTAAAATTTT
131881  ATTATAAACA AGTGTAAAAA ACAAAATCAC TAAAACACTC CCTCTTTTTT CCCCCAAAAT
131941  GCATGTTTCC ATTTTAACAG AACCCGTATT TAATCAGCAG ATTTCTATGG TGGCTAGATT
132001  TGTAGACTAA ATATTAAAAG TCCCAAAGCA AATGCATTTT TCTCTTAAAT TTTACTGACT
132061  TTTTTTTTTT TTCTTTTTCT GAGACGGAGT CTTGCTCTGT CGCCCAGGCT GGAATGCAGT
132121  GGCACAATCT CGGCTCACTG CAACCTCCGC CTCCCGGATT CACGCCATTC TCCTGCCTCA
132181  ACCTCCCGAG TAGCTGGGAC CACAGGCGCC CGCCACCACG CCCAGCTAAT TTTTTGTATT
132241  TTTAGTAGAG ACAGGGTTTC ACCGTGTTAG CCGGGATGGT CTCGATCTCC TGACCTCATG
132301  ATCTGCCCAC CTCAGCCTCC CAAAGTGCTA GGATCACAGG CATGAGCCAC CGCGCCCGC
132361  CTACTGACTT TTATCCAAAG AAAATATAAG AGCTCTTCAT CATAACGTAT GTTTCTTGCT
132421  CTTGTTATTA AATATGACAC ATTTAGACTT AAACTGATTT GAAGGTTTAT GACATTGTTT
132481  AAGTTATTAC ATAATTAATT CATAAAGATA ATGACTAGTT TGAACTACTG ACAGCTCACA
132541  CATCATCAGT TGAACAGCAG AAAGCTTACT AAGCTACTTT CTTATGTTTC TGTCTCCCAG
132601  CTACTAAAAG AAACGAAACC CTTCCAGGTG TTAAGGCAAA ACTTTCCTCC CCCTTTCTTC
132661  TATAAATCTG ATTCCATGTT AGTGAAATTT CTACTGATGG CTTTGGTTTC CTCTATAGTA
```

```
132721  GAATAGAGAT  CCTATGGCAA  AAGTCATGTC  TGACATGGTA  GCAAATAGAA  ATGGGGAAAA
132781  GGAAGGTCTG  CAAGAGCCAA  TGTGGGAAAT  GGGGAGAGGA  CTGACTACAA  AAACCCAGCA
132841  GGAATTCCAG  AAGAAAACTC  CTCAGGACGG  GCACATTGGC  TCATGCCTGT  AATCCCAGTA
132901  CTTTGGGAGG  CCGAGGTGGG  CAGATCACTT  GAGTCCAGGA  GTTTGAGACC  AGCCTGGTCA
132961  ACATGGCGAA  ACCTCATCTC  TACAAAAAAT  AAAAAAATTT  GTCAGGCGTG  GTGGCATGCA
133021  CCTGTAGTCC  CAGCTACTCA  AGAGACTTAA  GTGGGAGAAT  CACTCGAGCC  TTGGAGGTGG
133081  AGGTTGGTGA  GCCGAGATCA  CGCCACTGCA  TTCCAGCCTG  GGCGACAAAG  TGAGACGCCA
133141  TCTCAATCAA  TCAGTCTCCT  CGAAAAGCAA  CATTATGGAG  AGACAGGATT  CCGTCAAGGC
133201  CTGGGGCACA  CAGGAAAATA  TTAAGGCAGA  AGAGAGTTTC  CTCCCCACAC  CACACCGTAT
133261  CCCACAGGCA  CTGCGGATGT  GCATATGCAA  GAGGGGTTGA  TCCTAAGAAT  TTAGAGTCAC
133321  AGAGGAGGAG  GCACCAAGCA  GACTGTGGAG  AAAGTCATGA  CCAGAAAGGG  ACAGAATGTA
133381  AAGCTTCAGC  TGATTATCTG  GCCTCAGGGA  TTCCAGAGGA  ACTGGTCCCA  ATGGTCTCCT
133441  GGTGATGTAG  GTTCTTAGGT  TTCTTTTACA  GGGGTTTTCT  GGGAGATCGT  TGACCCAGTT
133501  AGCATTCAAG  CAACTTCCAC  CCTGCACTTT  TATTCTTTCC  CCTTCACCTG  CTTAGGTTTT
133561  ATCTGTCCAG  GAAATAATAA  TAAAATTATT  GAGCCCTGGA  CATGTACCTG  TAAAGCTCCT
133621  TAAAGATGAT  GCCTTCTAAC  TCCTCATTCA  ACAGATACAA  AAACATTACA  ATAAAATGAC
133681  TCATGCAAGA  CACCCAGGTA  GTTTATAGCA  GCTAATAAAA  ACAGAATAAC  TATAAAATAT
133741  GGTAAGTTTA  TAAAAGTTAC  ATTGAGTATA  CTTTATAAGA  ACTGCTTATT  GAGTTTGCCT
133801  AATAACCACA  CAGCACAATA  ATAATATGTA  TATATTTTTA  AATATGTGTA  AATATGTGTA
133861  ACACAAACTT  GTAGAAGGTA  TATCTGAGTA  CAACCCTATT  CTGTTTGGTT  ACCTTTTCTA
133921  GTTCATTATG  TAAGTGGCAT  AGCTACCTAA  GGACTTATGC  TTATAAATGT  TACTCAAAAA
133981  AATACAGAGG  ACATATGTGG  ATAGATAATG  GAAGAGATAA  GATAGGTAGG  TTGAAGGGTT
134041  GGGCTGCCCC  TCCACACCTG  TGGTTGTTTC  TCGTTAGGTG  GAATGAGAGA  CTTGAAAAG
134101  AAAGAGACAC  AGAGACAAAG  TATAGAGAAA  GAAAAAAAGG  GGTCCAGGGG  ACCGGTGTTC
134161  AGCATACGGA  GGATCCCACC  GGCCTCTGAG  TTCCCTTAGT  ATTTATTGAT  CATTATTGGG
134221  TGTTTCTCGG  AGAGGGGGAT  GTGGCAGGGT  CAAAGGATAA  TAGTGGAGAG  AAGGTCAGCA
134281  GGTAAACACG  TGAACAAAGG  TCTCTGCATC  ATAAACAAGG  TAAAGAATTA  AGTGCTGTGC
134341  TTTAGATATG  CATACACATA  AACATCTCAA  TGACTTGAAG  AGCAGTATTG  CTGCCAGCAT
134401  GTCCCACCTC  CAGCCCTAAG  GCAGTTTTCC  CCTATCTCAG  TAGATGGAAT  ATACAATCGG
134461  GTTTTACACT  GAGACATTCC  ATTGCCCAGG  GACGAGCAGG  AGACAGATGC  CTTCCTCTTG
134521  TCTCAACTGC  AAAGAGGCGT  TCCTTCCTCT  TTTACTAATC  CTCCTCAGCA  CAGACCCTTT
134581  ACGGGTGTCG  GGCTGGGGGA  CGGTCAGGTC  TTTTCCCTTCC  CACGAGGCCA  CATTTCAGAC
134641  TATCACATGG  GGAGAAACCT  TGGACAATAC  CTGGCTTTCC  TAGGCAGAGG  TCCCTGTGGC
134701  CTTCCTCAGT  GTTTTGTGTC  CCTGAGTACT  TGAGATTAGG  GAGTGGAGAT  GACTCTTAAC
134761  GAGCATGCTG  CCTTCAAGCA  TTTCTTTAAC  AAAGCACATC  TTGCACAGCC  CTTAATCCAT
134821  TTAACCCTGA  GTTGACACAG  CATATGTCTC  AGGGAGCACA  GGGTTGGGGC  TAGGGTTAGA
134881  TTAACAGCAT  CTCAAGGCAG  AAGAATTTTT  CTTAGTACAG  AACAAAATGG  AGTCTCCTAT
134941  GTCTACTTCT  TTCTACACAG  ACACAGTAAC  AATGTGATCT  CTCTCTCTTT  TCCCCACAGG
135001  AGGTGATGGC  CGGAAGAACA  TGGCAGAGGG  CAAAACAAAA  CAGCATTGGG  AACAAGCTCT
135061  GTTTAAAAGG  AGACTTGTGA  ACAGCAAAGA  GTAGAAAGGG  TTCTCTTACA  ACTGAAGCCC
135121  ATGGAAGACA  AATGTGTACT  GCGTGAGTTT  TAAGGCAATA  GGAGTAGTGG  GACCTAGGGC
135181  ACACCAGAGA  GCATATTAAC  TCTCAAACTT  TTAAAAACAT  TATATCTGCT  GGACACAGTG
135241  GCTCACACCT  TAATCCTACA  ACTTTGGGAG  GCCGAGGCGG  GCGGGTGTAG  CTTGAGCCCA
135301  GGAGTTCGAG  ACCAACCTGG  GCAACATGGC  AAAATCCCGT  CCCTACAAAA  CAAACAAACA
135361  AAAAACAAAA  TTAGCCAGGC  ACGGTGATGC  GTACCTGTGG  TCCCAGCTAC  TCAGAGGCTG
135421  AGGTGGGAGG  ATCGCTTGAG  CCCCGGGAGG  TTAAGGCTGC  AGTGAGCCAT  GATAATGCCA
135481  CTGCATCTCA  GCCTGGGCAA  CAGAGGGAGA  ACCTGTCTCA  AAACAAAAAC  AAAAACACAC
135541  CATACCCAAC  CACAATGCAT  CTGTCTTAAG  TACCAGTACC  ACACCCTCT  ACTCACTACT
135601  AAATAGGTGA  GTTCCCAATC  CCTGGTAGCA  GGTTTAAGCA  TGTTATATTA  AAGGTCTTAG
135661  GCTAGTGACT  CATTCACTCA  TTAAACAAAT  ACTTATTGTG  CATCTACTAT  AAACTAAGTA
135721  CTGTGCTAGG  TACAAAAGCA  AATAATCTAA  GCTCTATAAA  CTTTACTTTC  TTCATCAACA
135781  AAATGGAGAT  GTTTTAGGCA  TCTACTCATC  ATTCTGAGCT  CCATCTTTTG  TGACTGTAGT
135841  TGGCAGAGCT  TTTTATCAGT  TTCTCTAAAT  AGCTCTACCA  GTCCCTGGTG  GATGCTGGCA
135901  TGCCCAAAGG  ATCCATCCTG  ATGGCCCTGT  CTGCTTACCT  TACCTGCCTG  CCTTTGCAGC
```

```
135961 ACCGCTCTGC TCTTCTGCAG GACTTCCCTT ATCCTTTGGG GTCTTGCTGC TCTTAGGCTG
136021 CTCTGCTTGT TTTGATCTGC TTTGCATCAC ATGTATGTAA AGGTCCTTTC CTTATTTACC
136081 CATGACCAAG GTATTATGAG ATTCTGGAAT TTCCCCAAAC CACATTGATT GCTGGGAGAA
136141 TAGAAGAAGT GGATTACAAG TGGAACTTAG AAGGGGAGTA TTCGAGAAGA CGTCTCTGCA
136201 AATCCATTTA GAGAGACCTT TCTCCAGTGG TGACTCAAAG ATGCAGCTCC TTTCATCCTG
136261 TGGCTTGGCC ATCTTCAGCA CATGGCTCCC AAGGATGTCC TCAGGATGGT CTCTAATCCA
136321 AGGAGCCTGA AGAGAAAAAA AGGCATGGAG TATTGTGAGT GGTAGGTGGT TATGGACCAG
136381 TTATGGAAGA ATACACATCA CTTTTGCCCA CCTTCTACTA ACCAGAACTC ACACAGCCAT
136441 AGACACTGAC AAGTAGGACT TAACAAGAAT CTAATTTTGA GTCTAGGAAT ACGACTGTAG
136501 CAAATATTTA ACAGCTTCAA ACACAGGTGC ATTGCTATCA CTATGCTTGG CCCAGGCCTG
136561 TCTCCCTTTC CTGCCATGTC ACAGGGGCCA GCATTTATGT CTAGATTGGG TTGGTTGGGA
136621 TATTAAGACA ATAATGAACC AATACAACAT CTTGAGCATA AAACCAACTG ATACAATGAT
136681 GTACAAGTCA GATGATTCTG ATGATTATGA ATTATGTCAA TAAAAGAAAT GTGATAACTA
136741 AGGTAATTTT TGTTTTGGCA AATTTTTGTT TGTTCATGAC AGGATGAAAT CCTGTCATTT
136801 GTAGCAACAT GGATGGAATT GCAGGATACT ACATTAAGTG AAATAAGCCA GAAACAGAAA
136861 GTTAAACACC ACATGTTCTC ACTTATATGC AGAAGCTAGC TAACTAAGTA AATAAGTTTA
136921 TCTCATTGAA GTAAAAAGTA CAACAGAGAT TACTAGAGGC TGGGAATGGT AGGGGAAAGA
136981 GATGATAAAG AGAGATTCGT TAAAATAAGT TACAGCTAGA TAAGAGCAAT CAGTTCTAGT
137041 GTTCTATTTG TACTACAGAA TGGCAATAGT TAACAGTAAT AAATAATTTC AAAGAGCTAG
137101 AAAAGAGGAC ATTGAATGTT TCCAACACAA AGAAATGAGA AATGCTTGAA ATAATGGATA
137161 TTCTAATTAA TTACCCTGAT CTGATCACTA TACACAGTAT GTATAAAAAT AACACTATGG
137221 GCTGGGCGCA GTGGCTCACA CCTGTAATCC CAGCACTTTG GGAGGCCAAG GTAAGCAGAT
137281 CACTTGAGGT CAGGAGTTAG AGACCAGTCT GGCCAACATA GTGAAACTCC ATCCCTACTA
137341 AAAATACAAA AATCAGCCAG GCGTGGTGGC ATGTGCCTGT AATCCCAGCT ACTCAGGAGG
137401 CTGAGGCAAG AGAATTGCTT GAACCCAGGA GGCGGAGGTT GCAGTGAGCC GAAATCGCGC
137461 CACTGCACTC CAGCCTGGGT AACAGAGCAA GGCTCTGTTT CAAAAATAAA TAAATACATA
137521 AATAAATATT TTTTAAAAAA AGAACATCAC TATGCACCCC ATATATACAT ATAATTATTA
137581 TGTCAATTTG AAACATAATT TTGAAAAATG AAAAAATGAA ACACAAATAT GAATCAATCC
137641 TCTCCAAGTT GATATACTTA AAAGGAAAAA AGTCCGAGGG CTTAAACTAT TCAATCAAAA
137701 TTTTATTAAA ATGCTATAGT AATCTGGAAA GTATTTCAGA ATGAATTGGT ATAAGGTTAG
137761 ACACAAAGAT CAGTGAAACA AAACAGAGAA CCCAGAAATA GATTCACACA TCTATGGACA
137821 ACTGGTTTTG ACAAAGGTGT CAAGGCTATT TAATAAGTAA AAAAATCGTC TTTTCAGTAA
137881 ATGTTTCTTG AACAAGTAGA CATCCGGTGT GGGGGAGAGG AGCAGGAGCC TTACCTCAAA
137941 CTTTATGCAA AAATTAACTC AAAATAGACC ATAGACTTAA ATGTAAAAGC TAAAATTATA
138001 AAACTTCTTT AAAAAATAGG AGAAAATCAT CAACACCCTA GGATTAGCAA AGATTTCTTT
138061 AAAACAAAAC AACAGGTTTA TAGTTTATAA AACATAAATA ACAAAATGAT AAATTTCATC
138121 AAAAGTGAAA ATTTGCTTTT CAAAAAACAT TATAAAATGA AAAGCAGGAG GCTGAGGCAT
138181 GAGAATCACT GGAACCCGGG AGCTACAGGT TGCAGTGAGC CAAGATGGTG CCACTGCACT
138241 CCAGCCTGGG TGACAAAGTG AGACTCTTCC TAAAAAATAA ATAAATAAAT AAATAAATAG
138301 AAAAGAAAAA GAAAAATCAC AGGCTGAGAG AAAATATTTA TAATACATGT ATCTGACAAA
138361 GGACTCGCAC CTGGAAAATA TAAGGAACCT TATAACTTAG TAAGATGACA AGCCAAAACA
138421 AAGAGTAAAA GTTTTCAACA GACATTTCAC AAAAGAAAAC ATACAAATGG CCAGTATGCA
138481 CATGAAAAGA TTTTAAACAT CATTAGTTAC TAGGGAAATG CAAGTCAAAA CCACAATGAG
138541 ATACTTCACA TTCAACAGAA TAGCTAATGT TAAAAGGACT GACAATCCCC AGGGTGAGCA
138601 AGGGTGTGGA GGAAACTACT CTCATATATT GTGAATGTAA GAGGACAATG TTACAACTAC
138661 TTTGAAAAAA GTTTGGCTGT TTCTAACATA AAATTAAACA CTTATACAGC CCAGCAATAT
138721 TTCTGGGTCA TTTCTCCCAG ATAAATGAAC ACATGTCCAT ACTATGACAT GTACAAATGT
138781 TCATACTGGC TTTGTTTCAC AATGCTATAA ACTGGAAACA ACCCACGTGT CCATCAACAG
138841 GTGAATGGGT AAATAAATTG TAATATATCG GCCAGACGCA GTGGTTCATG CCTGTAATCC
138901 CAGAACTTTG GGAGGCCAAG ATGTACGGAT CACCTGAGAT CAGGAGTTTG AGACCAGCCC
138961 ATCCAACATG GTGAAACCCC ATCTCTACTA AAAAATTAGC TGGGCATGGT CACGGGCGCC
139021 TGTAATCCCA GCTACTCGGA AGGCTGAGGC AAGAGAATCA CTTGAACCGA GAGGCGGAG
139081 GTTGCAGTGA GCCAAGACCA TGCCATTGCA CTTCAGCCTG GCAACAAGA TGGAAACTCC
139141 ATCTCAAAAA AAAAAAAAAT TGCAATATAT CTATATCTTG GAATATTATA AAGCAATAAA
```

```
139201 AGGGAATAAA CTACTGATAT ATACACAAAA TGGATGAATC TCAAAAATGT GAAGGAAAAT
139261 AAAAAATACA TATGATATAA ATTCCATTCA TATGAAATTT TAGGAATGGG AAAACTAAGC
139321 TGTAATTATG GAAAGTACAT CAGTGGCTGC CTGGGGCCAA GAGGATGGAA GAGGCGGCAC
139381 AGGTGATACT ACAAATGGAA ACTATCTAGG TTGACGGAAG TGTTCTGTAA CTTGATTACA
139441 GTAGTAACTG TTTGGGTATA TAAAACGCAT CAAATTGTAT AATTAATACA GGTGTATTTT
139501 ACTGTGTATA AATTATTCCT CAATAAAGTT GATTTTTCAT TAAATATATT ATTTGCTAAA
139561 ATGAGGAGAG ACAACTATTA TCTTAAAATA GTTAAGCACA ATAAAAATAC TACAATCAAC
139621 TCATTATATA TGGAAATTAA AGGAGAAAAA TAGTGGTATG ATTAATTAAA ATAAAAAGAA
139681 AACCTTCTAA ATTTTATCTT AGCTCATAGT TGTAAAAGCT GCCATCCCTA ACCAAGGCCA
139741 CCCTTGACCC TTTCTCATGT TCCATCTTTC TGTTTGTTTC ATAGTTTATG TCTCACCAAA
139801 ATCTATCAGA TAAACGTATT CATATGAAGA TTTAAATATA TTACATGTTA AGCCTTAGCG
139861 AATACTTCAA TATCTAAAGA AGGTACAAAC AAAACAAAAA TCAACACTTA GTTATAAGAG
139921 ATTACATACT CTCCAGGGAA GACCTGAAGA CTAGCCCCTT TCTGGATCCC ACTAGCCCCT
139981 CATCCCACTC CAAGCCCTCC CCTCCAATCC CATATGCACT GGGCATTCAT ACAAATAAGA
140041 CCATCAGCTC TGGATATCTG TACTGATTGA TGCTCCTGCT AACTACCTGA ATGATTGCGA
140101 TGTAAGGACA GCACTGCCTG AATCCTATTT ATCTCTCGCT ATGCCATAGC GGCCTTCCAT
140161 GCTGATGGCG TGTTTGAGGA TCCAGAGGGG TCTTTGGTTG GCAGGATTGT TTTATTTCCC
140221 CAAGAGGAGA GCCTTGATGC AAAAATAGGT GAAGAAATCA GTACAACAAA ACAGAAAGCC
140281 TAGAAACTAC TATGAACACA ATAGAGCAGA AGTAGCCTTA AGAGTTGGTG GAGAAAGGAT
140341 GGTCTATTCA ATTACCTGGG CTGAGAAACT GGCTTTCATA TGGAATAAAA ATAAAATTAT
140401 AGCTATACCC CATATCATAC ACAAAAGTTT CTACATCTAA CAAAGACACA GATAGAAAAT
140461 GTTTTAAAAT TTTAGAAGAA AATAGTGCAG AATTTTAGTG CAGAATTTCT TAGACTAGAT
140521 GCAAAAACAA AAATGATTAA AGTGGCCAGG CACGGTGGCT TATGCCTGTA ATCTCAGCAC
140581 TCTGGGAGGC CGAGGTAGGT GGATTAGTGG AGGTCATGAT TTCGAGACCA GCCTGGACAA
140641 CATAGTGAAA CCCCATCTCT ACTAAAATAC AAAAATTGGT AGGGTGTGGT GGCTCACGCT
140701 TTTAATCCCA GCTACTTGGG AGTCTGAGGC AGGAGAATCA CTTGAACCTG GGAGGCAGAG
140761 GTTGCAGTGA GGGGAGATGG CGCCACTGCA CTCCAGCCTG AGCAACACAG CGAGACTCTG
140821 TCTCAAAAAA ATCTAAAAAT AAAAAGATTA TTTTTAAAAG ACTATTTTAA ACAAAAAAAA
140881 TCGTTTAAAT GATATGACAC ACTACATCTA ATATTTGGAA AAGTACTTCT TAATACTTTT
140941 AATAAAAAGA GGCGCTGAGA GCATACAACC TATCCTCAGA AGAGTGTTTG ACCTCTAGGA
141001 GGGACGCAAG CGCGTTCTTC CTTCATTTTA ACTGGTCATT TTCATTTATT TCAGGAACAT
141061 CTGAAGTAAA CACAGTCACA CGTTAACCTT TAAAAATCTA GGAGGTGCGT ACGCATAGTT
141121 CCATTACTTC AATTTTTGTA CTTTTGCATT TTAAAATATC ACAGGGAAGC TCGGTACAGC
141181 TTCAAGGCTA GGAGGGGTGG CTCTCTCTTA AGCCCTGTCC CCGCCAGCCC CAGACCTCTC
141241 GTCCCGCCCC CATTGCCCAG TCCCCACCCT CACTTCCCCA TTTCCCCACT CCCGCGGTCT
141301 CTTAACGCAC CTCGTTTTTC GTCCAGTGGA CTCAGACCTG TAGTCTTCCA CCAGGATCGG
141361 CTCCTTTCCC GGAGCTCTCG CTCTTAGAGG AAATTGAGAG AAGCATCAGC GGAGACCCAT
141421 CTGTGGCTCT CCAGAGGGCG CGGCATTCAG ACCCCAGATC CAGCTGTGAG AACGGACCCC
141481 AGGCTCACAC CAGGCCTGCG GGAGGCGGCC CACCAGAGGC GCTAGAAAAC AAGCCTCGCG
141541 GGGAGGCGCG CAGGGCGACT GCAAGCTGTA GGGGGCGCTG GCGCCCTCAC AGGCCAGGGG
141601 CAGGGCCGGC GCTGCGGGCG GGGCTCCTGC GGCGTGAGGG GCGGCCCCAG GCCAGCAGCT
141661 GCGCCCTGGC TGGGAGCCGG GGAGCATTTG CTGCTCTGCT GGACCCTGAG TCTGGCGGCG
141721 GGCGGCCTCC TCTCCGCTCC CCGCCCGCCA TCCCCAACT CCCGATCTCT CTGCTGCGTC
141781 TGGCCTCAGG CTGAGACCCC AACGAATCAT TCCCCGCATG GAACATTTT ATGATATAAC
141841 TGAATTCAGT TTTATGTATA ACTGAATTAC GGATATGAGA ATCTCAAATG AGGACGAATG
141901 GTTTTTACGC ACAAAACATG AGACACAAAT CTGTAAGAAA TATAAAGTCG TGACCACGTC
141961 CTTTCAGAAC TTTAACCTGT TTGCTGAAGT ACGTCAGTAA CAATGGCAGG GAAAGGGTAT
142021 CTTAAATTTC ACCACAGCCT CAAAGAGGCC ATTTCGTGGA TCCGCTGAGG CTTGGAGTCG
142081 GCCTTCTGAC CACGAGTCCT GCGGCTATGA AAGAGGAAGC CGCGGTTCAG GGCGTCCTCG
142141 CGAGTCGTGC AGCCCGCCCT GCTCCAGCTG GGACACCGG TGGTCACGGC GCTTTCCAGC
142201 TGCAGATCCA GGCGGCAGCC CAAGATTTGG TCCAGCCGCC AAGGGGTGGC TCGAGTGACT
142261 GACGGGCCTT GAACGCTCCC AGGACCCACA TCTGGAGAGG GAGGTGGGGG TGGGGTGCTG
142321 AAGTCATTCT TGGGGCCCCT GGGGGCGGGC ATGGACCTGG GTAAGGCCAG AGAAATTGAC
142381 ACCTCGTGAC ATCCCTGGAA GAGAAGTACG TTCAGTGTCA CTCCAGAGCT GAAACCGCCT
```

```
142441 TCTGGCTGGT CCCTCCTCAC CTACATACTT TTCTAATTTG TCTGGAGCAG GCCGGGCATC
142501 TGTATTATCT GGTTATTTAA ATATCTGGTT ATTTAAAAGC TCTCCATTAA ATTCACATAC
142561 ACGAAAATAA AAATTAAAAA AAATTTTAAA AAAAAGAAAC AAAAGCTCTC TAATGACCAA
142621 GTCCTACACG ATAGTGAATA AATTTTTTTG TGTGGTCCCT AAAATTGAGT TCATGCCTTT
142681 TCTGAAGTAA TAGACGCCCA GAGAAGGGAT CGACTTACCC ATCATGCCAC AGAGATTAAT
142741 TGGCCCCAGA ATTCTTTAGC AGACCGTGTA TATGAACGTC CTTTGCAATC ATATAAATTA
142801 ACTGGGAAAA CCTCATTTAG TATGTTACAT GCCTAGCGTT TTGTGCCTGA ACACCTTACA
142861 AGAACCAGGG ACTATTGCCC CAATATTATA TTTCAGGAAA GGAAGGCCCA GACAAATGGT
142921 GTCACTGGTC CACTTTCACC CAGTTGGTAA ATGAAACCAG AAATTATAGC TGTACCACAG
142981 AAAGGTGAAA ACGTTTCTTT TATAATTTCA CATACAATCT TTAATGGACC CAGTGTCCAA
143041 CACATTAAAG CAAGTGCTCA GGAGTGACAT CAAGATGTAA AAAATAGTCC TGTCCTCAGG
143101 GAGTTTAGGT CTTGGAGAAA AGAGACCCAA GGAGACACAA GACAAAGGGG AAAGAGAAGG
143161 AGCGCTGAAG ACTGAGGACC CTGCCTGTGG ACTGAAGTGA GGATGGGGAC ACCCGATGCC
143221 CGGAATATGA CAGTTTGGAG GGGCCTGAAG GACTCTTCTA TTCTCTATCA GAAAAACAGA
143281 ATTACTCTCC TAACCAGAAA AGGTATTTCA ATTTATATTT TCCATCACAG CACTTTTCTG
143341 GTGATAATTT AATGTGTTTT AAAAAATGTA TCACAGTGAT GGCCTGGTGT GAAATAAATA
143401 ATAAAATTTT AAGAATTAAA AAATATAAAA ATCTTTTATA TAGACATTAG GAGTTACAAG
143461 GATAACTGTG AATTATAATT AGTAATTAAA TTGAAATACT GATTATTTTC ATTTTTATTT
143521 AATTATTTAA TAAAACCTAT TTAACATTTA ATATTTATCA GTAATTAAAT CTAATTGTTA
143581 ATATTTATTA TTATAAATTA TTTTAGAATT AAAAATAAGT GTAGAAGCGA GGCATGGTGG
143641 CTCAAGCCTG TAATCCCAAC ACTTGGGAG GCTAAGGTGG GAGGATTGCT TGAGCCCAGT
143701 AGTTCAAGAC CAGCCTGGC AACATGGAGA AACCCTGTCT CAATACAAAA AAATGAGCCA
143761 TGTGTGGTGG TGCGTGCCTG TAGTCCCAGC CATTCTGGAG GCTGAGGTGG GAGGATGACT
143821 TGAGCCTAGG CAGTCAAGGC TGCAGTGAGC CCTGATCTTG CCACTGCACT CCAGTCTGGG
143881 CAACAGAGCA AGACCCTGTG TCAATATACA TATGGACAAA CTTAAAATTT AAAATGAAAG
143941 CATACTACTG ATACAGAATT GAGTAGAGAT GCAAAGCTAG TCCTATAACC AGAACAATAA
144001 AGATAAAAAG GAGAGTGGAA GAAGGTATGT CATGAATTTC ATGATAAATG GCAATTGCAA
144061 ATATCCTGTA GCAGAACAAA ACAACAAAAC TGTAGATAAA ACATATCCAA CCCTTTGGAA
144121 GGCCAAGGAG GGAGGATTGT TTGAGCCCAG AAGTTGGAGA CCAGCCTGGG CAACATAGTG
144181 AGACCCTGTA TCTAAAAAGG AAGAAAGAAA AAAAAAAAA GGATGATAAA GTAGACAATA
144241 TTGAAAGCCA TTTTCTGCAA ATACATAGTG AATTTGATCA GTAATTTTCT TCCAACAGTG
144301 CAAAAATGAA TAGATATTAG TTGCCTGAAA TAAAAATCAA ATATCCAACA AAAAATATTG
144361 ACTATCTAAT AGTATCTAAG CTAGTAAATT TGGCCAGTTA TAAAATGTCT TAAATTTTTA
144421 TTTAAAAAAA GAAAACCATA TTTATAAGAA GAGGTGATAA AGAGAAATTA TTTCAGTTAT
144481 GAAGATTTTG TTAGAAAACT ATGAGAAAAA AACTATTTTT TGTTTTCAAA AAGTGAAAGA
144541 TTAAGTTACC AAACAGTTGC TAAAGAATAC CAGATGGCTG AGCGTGGTGA CTTATGCCTG
144601 TAATCCCAGT ACTTTGGAAG GCCAAGGCAG GAGGATCATT TTAGGCCTGG AGTTCGAGAC
144661 CAGCCTGGGC ACTGTAGCAA GACCCGTCTC TATTAAAAAA AAAAAAAAA AAAAAAAGA
144721 ATACAAGACC TTGCTAACAA TAGCAAAGAT CAATTAATTC AAAATTTGAA AAACTGTAAT
144781 TTATTTAGCT TTAGAGTACT CTCGTGATAT GAGATTGCCA AATTAATACT TTGGGTGCAT
144841 TTCTTTTCTC AAAGGACTTG CAAATTTACA AAGAAGTGTT GAAGAAAAGC CACACATTGG
144901 CAGGTAATGT TTGCAAAAGA CAGATCTGAT GAAGAACAAT ATTTTTAGAA TATACAAAGA
144961 ATACTTAAAA CTCAACAGTA AGAAAATAAC CTGATTTAAA GCAGGCCAAT GACCTGAACA
145021 TCTGTTCACC AAAGAAGATA CACAGATGCA AGTATGCATA TGAAAAGATG CTTGACATCA
145081 TGTCATTAGG GAACTGCAAA TTAAAACAAG TAGATACCAC TGCATACCTA GTAGAATGAC
145141 CAAAATTTAG AACACTGTCA GCACCAAAGG TTGCAAAGAT ATGTAGCAAT AGTAACTTGT
145201 TCATTACTGG TGAGAATGCA AAATGTGCAA TCACTTTGGA AGACAGTTTG GTGGTTTCTT
145261 ACAAAAGTAA CCATACTTTT ACCATAAGAT TCACCAATCA CACTCCTTAG TATTTATCCA
145321 AAGGAATTGA AAACTTATCT CCACACAAAA ACCTGCACAT AGATGTTTAT AGCAGCTTTA
145381 TTCATAATTT ATCCAAAACT TGGAAACAAG ATGTCTTTCA GTAGGTAAGT GGATAACTGT
145441 GGTACTTCTG AATAATGGAA TGTTATTTAG AGTTAAAAAG AAATGCATTC ACTTTGGGAG
145501 GCCGAAGTGG GTGGATTGCT TGAGGCCAGG AGTTTGAGAC CAGCCTGGTC AACATGGGAA
145561 AACCCCAATT AGCCGGGCAT AGTGGCGTGA GCCTGTAATC CCAGCTACTC GGGAGGCTGA
145621 GATATGAGAA TCGTTTGAAC CTGGGAGATG GAGGTTGCAG TGAGCCAGTG CCACTGCACT
```

Figure 1 (Page 45 of 73)

```
145681 TCAGCCTGGG CAACAGAGCA AGACTCCTCT GTCTCAAAAA AAAAAAAAAA AAGAAAGAAA
145741 AGAAAAAAGA AAAAGAAAAA GAAAAGAAAC GATCAAGCCA TGAAAACACA TGAAGGAAAC
145801 TTAAATGTAT GTTACTAAAA AGCCAACCTG AAAAGACTGC ATACTATATG ACTCCAACTG
145861 ATGCAGGGCA AGCAAGCCAA AAATTAGGGC TTAGCCCGGG AAGAATTCAA GGGTGAAGTG
145921 GTGGTGTTAG CAACTTTTAC TGAAGCAGCA GTGTACAACA GCAGAACAGG TACTGCTCCT
145981 TGCTGAGCAG GGCTAACCCA TAAGTAATGT GCCCAGAGTA GCAGCTCAGG GGCAGTTCTG
146041 CAGTAATATA CCTGCTTTTA GTTAAGTGCA TGTTAAGGGG GATTATGCAG AAATTTCTAG
146101 AAAAAGAGTG GTAACTTCGG AGTAGGTACA GAGGAAAGAA GTCGATAATG TCCTGTTGTT
146161 GCCATGGCAA CGAAAAACTG ACATGGCGCT GGTGGGCGTG TCTTATGGAG AGGTGCTTTA
146221 ACCTCGTCCC TGTTTCGGCT AGTCTTCAAT CTGGTCCGGA GTAAAGTCCC TGCCTCCGGA
146281 GTTCACTCCT GCTTCCTGCT TCACAACTGT ATGACACTCT AGAAAAGACA GTAACTATGG
146341 ACACAGTCAA AAGATTAGTT GATAGAAATT GGGTGACAGG AAGTGTTGAA AAGGCAGAAC
146401 ACAGGATTTT TAGGGCAGTG AAACTTCTGT GATACTATAA TGGTGAATAC ATGACATTAT
146461 ACATTTGTCA AAACCCATAG AAAGCACAAC ACCAAGAATA AACCCTAATG TAAATTACAG
146521 ACTTTCGTTG ATAATGACGT GTCAATGTAA GTTCAATTGT AATAAATGTA CTACTGTGGT
146581 GCTGGATGTC TATGGTGGGG GGACATTTTT GCTTCAATAG TTACAGTTGA AGTAAATGTT
146641 TGTGTTTCCC ACAATGCATA TGTAGAAACT CTCACATTCA ATGTGATGGT CTTTGGAGGT
146701 GGGCTCTTTG GGTGATAGTT AGGTTTAGTT GAGATCCTAG CAGATCGAGT CTTCATGATG
146761 GGCATGATGG GACTGGTCCC TTATAAGAAA AGACCAGAAA GCTAGCTCTC TCTTTGCCAT
146821 GTGAAGACAT AGCAGGAAGG TAGCCATCTG CAAGCTAGGA AAGGGCCTTC ACAAAGAATC
146881 AACTCAGACC TCAGAACAGT GAGAGATAAA TTGTCGTTGT TTAAGTCACT CAGGCTGTGG
146941 TATTTTGTTT CAGCAGCCCA ACCTAAGACT GTTAATTGGA TTAGAAATTT CCTTTTGGGG
147001 ATGGTGTGTG GCGGGCGGGG GGCGGGGAGT ACCTTTGTTA AGCTTTTATA TCAATGAGTT
147061 TGTAGGCTTT TCTTTTTTGG TCATTGACTA GGACAGTTTA AATAGTATGA GTGTGAAGGA
147121 GATTGTTGGT CATCTATTCG ATGTCCCTTC TCTGTTTTTT AATATGAGAA CTCCTGATTT
147181 TCAGCCAACT ACCCTGGAAA AAAAGCTAAT CTTTCTGACT TCTTAAGTGT GGCCATGTAC
147241 TAAATTCTGG CTAATGCAAG GCAAGCCAAA GGTTTTATGA TAGGTTTTAG GACACTAGAG
147301 TAAAAGAGAG CTGTTGCACA CATGCTCTTC ACCCTACTTT TGTGTCCTTT TTTCCATCCT
147361 ACAACTTGGG TTGTGAGTAT GATGGCTGGA ACTTTAGTGG CTCTCTTGGA TCCCAGGGGT
147421 AATTGAGGGG TGGCTGGAAG GAATCTGTGA TTTTCTGGAG TTTCCATACA CAAACAAGAC
147481 CTGGATTTTC TGGGCTTCCC AGACTTCCAC ATCTAGACTT GCTTTAAATG GGAGATAAAT
147541 AAACTTGTTT CAGCCACTGT CATTTTGGGC TATTTTATAG AACTTAATCT AATCTTCAAG
147601 GGTACATGAA TTGCTTTTCC TTAAAAAAAA AATCAGCCAT AAAATCATCT TCTTTTTTCT
147661 TTTGTTCCCC ACATTATTTA GTTGGAGCTC TGTAACTTTT TTTTTTTTTT TTTTTGAGAC
147721 AAGGTCTTGC TCTGTCACTT AGGCTGGAAT TCAGTGGCAT GACCATGGCT CACTGCAGCC
147781 TTGCCCTCCT AGGCTCAAGC AATCCTCGTC TCAGCCTCCT GAGTAGCTGA AACTAAGGCA
147841 CATGCCACCA TGCCCAGCTA ATTTCTTTTC TTTTAGAGAT GGGAGCCTTG CCCAGGCTAG
147901 TCTCAAACTC CTAGCCTCAA GTGATCCTCC CATCTCAGCC TCCCAAAGTG ACAGGATTAC
147961 AGGTGTGAGC CACCATGCCT GGCTGCTCTG TAAGTGTCTG AATTTCATTT TGTATTTATC
148021 AGTCTGTTTA GATTTTCTTT CCCTTCTTGG GTCAGTTAGG CCATTGGTTT CTTTTTAAAG
148081 GTTTTCAAAT TTATTTGCAT CTAATTCTTC AAATTACTCT CAAAATTATT CCAGTATATA
148141 TTCTTTTGTT CCTATTTTCT TCTGTATTCT TTATTAAAAT AGCTAATGAT TTATCTAGCA
148201 GGACTTATAT TCTTTCCATA ACTTTCCTGC ACCCCAATTA ATCTCCAATT TTATATTTCT
148261 TCTGGCCTTC CTTATAGTTT CCACAGGTTT ATTTTATTCA TTTTTTAAAA CTTTTATTTA
148321 ATTGTTTATT TTATTATCAT TCTTTCTTAT TCAGCAATCT AAGTGCTTAG GATATAGAA
148381 TTTCCTCTAA GCAGCATATG CTAGGCTTTA ACAATGTTAG GGAGGCCTCC CCTTTCTGGG
148441 GAAGACCACA CTTACATTAA CACAGGACTG TGGGATGCCA AGAGGTAGAG AAGAGCTTAT
148501 GAATATCCAG ATTACATCTT CACTGATCCT GCACAAAGGT GGGGTTCCTC GGTTACCCAC
148561 TGGGTCCTAT TACCCAAGTC TGGGTCAGCA TACCGAGACT ACGGGTATAT AGAACAAGTG
148621 CAACTGGCGA TAATCCTTCT GTTGGGGAGA AAAATCTTTT TTTTCTATTC ATCTTAGGTT
148681 CTCCATCTGT GGCCCTATCA AGTAGACTAA CAAAAGACAG ATTGACAAGA CAGAAACAAA
148741 GCATGTGCAT TGTACAAACA CAGGGGAGTA CTGAGATGAA TACTCAAAAG AGGATTTAGA
148801 ACTTGGGCTT ATATAGCATT TTAAGAAAAG AATACATTTT TTAAGTGACA AGGAAGACGA
148861 AAAGGACTTT GAGTTTCTAG TGCAGTAAAT TGTGGGAAGG CAACTTTTTC TTTCCCTTTT
```

Figure 1

```
148921  TTTTTTTTTT  TTTTTAAAAA  AAAAGACTTC  TCTGGTGCTA  TGTCCAGGCT  GATAAGAGTC
148981  TAAAGTCTCT  GGTGACTAAC  TTTTGTTCTT  CCCCGAGTAA  GAAGACACCT  TCACAATTTC
149041  ATATCCTGCT  TTTAGGCAAA  TAGGGAGAGG  GCAGAGGTGT  TTGTTTGTTT  TTAATCTATT
149101  TTTTTTCTCA  ATTGTCTTCA  ACTCAAAATA  CTTCTTATGC  CAAAGATGGC  ATATTCTGCT
149161  ACCCTTCACT  TACTACTTAC  AACCCAGCCT  CTATCATCAT  AATTAGAACT  TCTGACCCTG
149221  GGGAACATGG  GCAATAGTTT  GAACTCTTTT  ATATCTCCCT  TAGGCAGAGA  TGGAGGCCCA
149281  GCCATGCCTC  TGACATCTAG  ACACAACTGT  TGCTTCATTT  CTCCTATTCT  CAGAGGTGAT
149341  GTTGTAGGAC  TTCAACAAAT  ATCAGTAAAC  ATTAATTTTT  TTTTTCCTTG  AGGCACAGCA
149401  TGATCTTGGC  TTACTGCAGC  TGCTGCAGGC  TCAAGCAATT  CTCCTGCCTT  GGCCTCACGA
149461  GTAGCTGGGT  TACAGGCCCC  TACCACCATG  CCCGGCTAAT  TTTTGTATTT  TTAGTAGAGA
149521  CAGGGTTTCA  CCATGTTGGC  CAGGCTGGTG  TTGAACTCCT  GACCTCAAGT  GATCCACCTG
149581  CCTCAGCCTC  ACATAGTTCT  GGGATTACAG  GCGTGAGCCA  CCATGCCTGG  CCATCAATTT
149641  TTATGTCAAC  TCTAAATTAT  AACATTTAGC  AATTTTGTGA  CTTTTTATGG  TCATCATTAA
149701  TGTTGTTTAT  GTTTTAGTTG  TAGTCCTGTC  ATTACTCACT  CGGGTATGGT  AATTTGGTCT
149761  TTTTCAAAAT  GAAGTTAAGG  TCTATTTGCT  CTTCTCTGAA  TCATAATAAG  AACTGCCAAC
149821  AGCCATTTCA  GCAATAACTA  TTTACTGAGA  TTTTAAAATA  TTTCAAGGTA  ATTGGTCCTA
149881  GCAGACTGGA  AAATACCAAA  TTCTTTTCCA  GAACTGAATC  CCCCATCAAA  GTTCAATTTT
149941  ACTCATAATT  CCCTTTTCAT  TTGAAGCATC  TCATTGTAAG  CCAGTCTTAA  CCCTTCTCTC
150001  ACACTTTGCT  TGGCTGTTTC  TCAGGTAGAA  CTCAGTAAGT  CTGGTAGCCT  CCAGGACTGC
150061  CGCTTAGATT  ATTAAACAAC  ATGTCAGTGG  TTGGAAGAGT  CAATGTTATT  TTGATTTTTC
150121  TGTTTTGTTT  TGTTTTAAAT  GCAGTTGGCG  GATAATTGCA  GCTTTCTTTC  ATTCCCTACA
150181  TGAGTTCAAA  TGGCAGCAAA  CAAACTAGGA  GAACGCAGAC  CTTCTGACTT  GTGGGTACCC
150241  CTACTCATCA  CCTGAAGACC  CTTGGAAATC  AAAGCCCTGA  CCCATTAAAG  ACGGATGGAG
150301  ACAGCAACAT  ACGATCATCA  CTATTATCTT  GCTTTGCCCC  AGTCCAGGTT  AACCATCTGT
150361  GGTATTTTTA  GTTGCTAAGT  CCATATATTC  AACATAAATC  AATTATATAT  CCACTAAAAT
150421  CTCAGCACTA  GTCTAACTAC  TAAGGAAATG  ACAGCAAGA  AAACAGACCA  AACGTCTGCC
150481  CTTATGGGAT  TTATATTATT  TTCTCTGTGC  TGGTTAAACC  AAGGAGCTTC  TGCTCTTTTC
150541  CTTAGTCACC  TGGGGGAGGC  AGAAACAAAG  GAGAATATTG  ATAAACCTGG  AAATAGGGCC
150601  GGAGAGTATC  AGAGAAGGAA  GCCTTCGGGA  AAGTAAAGAT  GTGGCAGCCA  GTATTCCCGT
150661  TATAAAAGGA  TACAACTCCG  GCCTCATAGT  CCAGAAAAAT  TCCCACAAGC  AGGGGCTGCT
150721  CATGCAGATG  AAGGGAAGTT  GGGGGAGAAG  TAAGTGCTAC  ATAGCCTTTC  TTTTTGCACA
150781  GCCTGAGGGT  CCAGAATCCA  GACTGAGGCT  CTTGCTTCAT  GCCAGTGCCC  CTCTGCACAT
150841  TTTCCATACA  AACTCCTAAA  TCCCATCCGG  TTCCTTCGCC  AACATCCACT  TCAAAGTAAC
150901  GTCTTCCTGA  GGTGAAGCCT  TCACAACCCA  AGACACAGGG  GAAGGCAGTA  AATCTCCTGG
150961  AAGATGTGTC  CTGATTCTCC  TGGGTGTATC  CACGAGTCAC  TTGTCTCCGA  TCCTCAGAGA
151021  GAATTAGTTC  GTGATGAGCT  GTATCTGGAT  CCAGAGTCAC  ACTAACTGCA  AAACAAAACA
151081  AAACAAACAA  AAATAATTTT  GTTGCTGTGA  AGAACACAGG  TTATTTTATT  TTATTTTATT
151141  TTGAGATGGA  GTGTTGCTGT  CACCCAGGCT  GGAGTGCACT  GGCACTATCT  CAACTCACTG
151201  CAACCTCCAC  CTCCTGGATT  CAGGCAATTC  TCCTGCCTCA  GCCTCCGGAG  TAACTGCGAC
151261  TACAGGTGCG  CACCACCACA  AGTGGCTAAT  TTTTTTAAAT  TTTCTGTAGA  GATGGGGTTT
151321  CGCCATGTTG  GCCAGGCTGG  TCTCAAACTC  CTGACCTGAA  GTGTTCCACC  CACCTCGGCC
151381  TCCCAAAGTG  CTGGATTACA  CAGGTGTGAG  CCACCATGCC  CAGCCACAAG  TTATTTTCAA
151441  TAAAACCAGC  CTGTGTTCAA  ACCCAACTAT  TGTTTCTTAT  AAACTGGGTG  AGCTTAGGCA
151501  AATCATTTAA  CTTTCTGAGC  CTCAGTTTGT  TAACTATAAA  GTGGAAATTA  CCGTATTTGT
151561  TGCAGAGAAT  GGTGGGTAGG  ATTGAATAAG  CTTATGTTTG  CTTAATGCTT  GGTAAAATTC
151621  CTGGTACATG  GTAACCACCT  AATAAGTGGT  AGTTGTTGGG  GTGATCAGGC  CCAACACCAG
151681  GCCGTGGGGG  CTACAAAGTC  CGGCGGGTC  AAAGGAATGA  GAAAAGACAA  GTTAAGAGTG
151741  CATAAAGTGG  GTCCAGGGTG  CCAGCACTAG  ATTGGAGGCT  GCAAAGGCCC  TAAGCTCTGG
151801  GAGCCCACAC  TATTTATTGG  TGATCAAACA  AGAAGCAGG  TGGTGAGGAC  GTGAGGGTAA
151861  ACAGGTGAGG  GCATGAGGAC  ATGGGGGTAG  AAAGGTAGTG  GTGCATTAAG  CGTAGCTGTG
151921  ACAGTTTAGC  ATTTTCTTTG  ACACATGTAG  AATATACTCT  GCTGCTTGAG  ATAGTAGAGG
151981  ACACGTTTAT  GAGTGAAAAG  CAAGGAACCA  ACAAGTCTGT  GCACTTTCCA  GAGGCTATGA
152041  GGGGTTTTAT  GCCCTGAGCC  CTGGGTTCCA  TCCAAGCCAC  AAGGGGTTTT  ATGCCCTAGG
152101  CTTAGATTTG  TGGTGCGGCA  GGGCAGCCTT  CCACCATTTG  GCACAGAGCT  TGGTGTTCCA
```

Figure 1 (Page 47 of 73)

```
152161 AAGGCCACGA GGGGTTTTGG ACCCTGGACC CCGGACATCT TCCAAGACTC TTTTACATTA
152221 TGACAGACAA GCCAGTCCTG CTTCAGCTCT TCTAACAACA TGTAGTAATA ATGATATCAT
152281 CAACATCATC TTCGTCTTAA TTATTCAAGG ATGCCAAGGT ACAGAACTAA CCTGTTAATA
152341 TGGTTACCAT CCTGTCCAAA GTTCTTCTCC CATGCAGGAC TTCCAGGAAT CATGAGACAG
152401 TTGAGCAGAA AGATACCTTT TCCCTTCTCT ACTGAATAAC CACCAACATT GAGAATCAGA
152461 GAGGGAAAAT GACTCAGCTA ATGTCTTAGC TTGTTATTGG AAGACCCAGG TCTCATGACA
152521 CATGCCTAGT CCCATGACTT TTAATTGTAA GCTCTTCTCT TTCCCCTCAG ATAATGTTCC
152581 ATAAGCATTA GTATGAGATA ATAATACACT GAGGACCAAT ATACATGAAA AATATCAGAC
152641 TAGAATCAAA CAAGACAGAA AAAAGATCTG ATAACCTAAA GTGAGATACT GAACAGTATG
152701 CAGTTTTAAA AATAAAAAAT GGTAATAGGA TGTTCTAACA AGAGAGTTAA GAAACCACTG
152761 TGCTACTGAG TTAAATGTTG ATCAGTTGGT CTGTGACAAT TAAGGAATTC AAGTATTCAG
152821 AAACACTTCC TGTGCTGGAT GCTCTCTGTT TGTTCTTCCA AATAATCCCT CACTTTTCCC
152881 TGTCTTGCTC TGTGCCCAGG AAGGCTGACA TGGACAGATT AACCAGGCTT TCCGCCCTCT
152941 GGCTTGGTTC AGCCAATGGG AAGCACCAGA GGAGACCATA GGGCACAAAG AAGCAGCCTT
153001 GGGAGTATTC AGTACCCCAG TCCCACGCTA TGATTTGGAG GGTCTGCATT CCTCTGCCTC
153061 TGGGCACACT CTAGTATAGT TACAGCTCCC TACACCTGCC ACTTGAGGCC CAGAGGAGGT
153121 GATGGCTCTC TAACTGTTCC TAGTTCTGGG TGCTTCCTGT TCCTTGTGGA TTTCCCAACT
153181 CCTCACCTTT GTAAATACCC TCCTTTTTCA AACTCTATTC AGTTAGCTTT TATCAGCCTG
153241 ACTCACAGAA GTTTGGGGTT TCAATTCATA TTACCTGAAT GACCCAGGAA AACCCATGTT
153301 GAGAAATTAA AATGTTTACG GGGTGGTAAT ACCACTTAAG AGAAAAAATA TCAATTGGAT
153361 TTTTAAAATT CCACCTATCT ATTGGTGTGA CACATCAACA AAAACATATA GAAAGATTGG
153421 AAGCTAAAAG ATAGATAATA TAGTCATATA CTGTTATAGT ATTATATCAA AAGATATTAA
153481 GTCAGAGCAT TATTAAGAAT GGAAGAAGGG CCAGGTGTGG TGGCTCATGC CTGTAATCCC
153541 AGCACTTTGG GAGGCCAAGG CAGGCGGATC ACTTGAAGCC AGGAGTTCAA GACCAGCCTG
153601 CCCAACATGG CAAAACCCTG GCTCTACCAA AAATACAACA ATTAGCTGGG CATTGTGGCA
153661 CATGCCTGTA ATCCCAGCTA CTTGGGAGGC TGAAGCACAA GAATCACTTG AACCGGGGAG
153721 GCAGAGGTTG CAGTGAGCTG AGATTTCGCC ACTACACTAC AGCCTGGGTG ACAGAGAGAG
153781 ATTCTGTCTC AAAAAAAAAA AAAAAGAAAG AATGAAAGGA GTCACCTAAA AAAGATAACA
153841 CAATTTTAAA CATAAATGTA CTACATTATT AGTGAATTCA TGTTTAGAAT TGTGTTAATA
153901 TACAAAGCAA AAATTGTAGA ATTATAGGAG AAATGGACAA ATCTACAATC ATCATGGGAT
153961 GTTTTAACAT TCTTCTTTCC ATAATTGATA GATCAGGCAG ACCAAAAGAA AGAAATAAGG
154021 GAAGATACGG AAGGTCTGAA CAATCTAAGA AGCGCAATCT CATAGTCAAT ACATAAAGCT
154081 CAGCAATTGT TTAATAATAG TAAGCAGAGA ATATGCAGTT TTCTCAGGTA TAGATGGAAC
154141 ATGCACTAAC TGAGTAAATA CTAGGCAGAA AACAGTCTGA ACAAGTTTCA ATAAATCTGT
154201 ATTACACAGA TCATTTTCTC TAGCCTCAAT ATAAGATTAT AAACCAATAA TAAAAAGATG
154261 ACTAAAAAGA TTCTAAATAT TAGGAAATGT AAACTACTAA TAAGTCATTA GAAGATGTAT
154321 AGAATGGAAC AATAATAAAA AGTTATTTAT AAAAATATAC AATGAAGCTA AAGCAGAATT
154381 TTAAGGAAAA TTTGTAGGCT TTAAATGCTT ATCTTAGAAA AATTAAAAAG CTGAACATTA
154441 ATGAGCCAAG CATCTAATTT AAATTTTAAA AAGAACATAG AAAGCCAAAT ATAATTTTTT
154501 AAAAAGAAAA AATAGATATT AAACAATATA ACAGTGAAGT TAAAGAAAAC AAGAATGCAA
154561 TAAAGAGGAA AAACAAACAA AAAAAAAGGT AGCTTCTTTT AAAAGAAATT TAATAAAATA
154621 GACATACCTC CAATGAGATT TATCAAAGTA AGACAGAAGG CACAAATGGA ATGAATACAG
154681 AAACTTTTTA AATATTACAG AACTTTATAA TAAATCTTAT GCTACTAATA AAATTGAAAG
154741 TACTGATAAA ATTATTACTT CCTAGAAAAA ATATTTCTGA GTAAAACTCA CTCAAAAAAC
154801 AAATAAAGCA TGGGCAGACC TAACATTAAA GAAATGAAAT CACTACTTTA AATTTTACCG
154861 ACAGATAATA AAACGTGCAT CTTTATCAAG CAAAAATGGA ACTTGTCAGT TTTATAGGAA
154921 ATTTAGAAGT CAAGGCATGA GTAATGCCAA TCTCATACCA AATCCTACAA AGAATAGAAA
154981 ATTATGGCTC CCGCTTATAG ACATAGATAT AGAACTCCTG CACAAAATAA TATAAATAAC
155041 AAACCAAATT TTATATTTGC AACTATACAT ATTATATGTG TATGTATTAT ATATGTTAAC
155101 ATATACATAT ATAATATGTA TAGCATATGT TCTACATATT ATATATGTAT AGTGTATGTA
155161 TTTTACAATA TATAAATGAA AACCCAATCT TTAATATATT CATCTAGATT GTCATATATG
155221 ACATATATAA TACATTACAT CAAAAATGTG TACAATAATC AGGCCAGGCA CAGTGACTCA
155281 TGCCTGTAAT CCCAGCACGT TGGGAGGCTG AGGCGGGTCA ATCACTTGAG TCCAAGAGTT
155341 TGAGACCAGC CTGGTCAATA TGGCCAAATT CCATCTCTAC AAAAAATATG AAAATTTATC
```

```
155401 CAGGCATTGT GGTGCACACC AATAGTCCCA GCTACTCGGG AAGCTGAGGT GAGAGGATCA
155461 CTTGAGCCTG GGAGGTGGAG ATTGCAGTGA GTCGAGATTG CGCCAGTGCA CTCCAGCCTG
155521 GGTGGCAAAG GGAGACCCTG TCTCAAAAAA AAATTAAAAA ATTAGCCAGG TATGGTGGCC
155581 TGTTCCTGTA GTCCCAGCAA CTGGGGAGGC TGAGGTGAGA AGATCACTTT AGCTCAGGTG
155641 GTGGAGCCAT GATCGCACCA CTGTACCACT CGGCTTGGGC AACAGAGTGA GAGCCTGTCT
155701 CGAAAAAACA AATATATACA CACAGTAATC AATATATATA TTATATGTAC CAATCAATGC
155761 TTCACTTTTA TATATAATAT AGATTACATC TTATTAGATA TATAGTATTC CTTCTCCATA
155821 GATAGATAGA TACAGATATA GACATAGTAT CCTCTATCCA TATTAGAGAG AGGATACTAT
155881 ATATATCTAT AGCATATAGA GATGCTGTCT CAAAAAAATT TAAACATCAG CCAGATGTGG
155941 TGGCCCATGC CTGTAGTCCC AGCTACTGGG GAGGCTGAAA TGAGAGGATT GCCATTGATC
156001 CTCTCATTGG TTGAGCCATA ATCGCACTAC TGCACCACTC AGCCTGGGAG ACAGAGGGAG
156061 ACCTGAGGTG GAAGGATATA GATATAGATA TATAAATAAA TATGTATAGA GAGAATATAA
156121 TATATGTGTG TATGTGTATA TATATATATT ATGAAGACAC TGGGAGAGAA TACTATATAT
156181 ATATGTGTGT GTGTATATAT ATATTATGAA GACACTGGTG GGATGGTTTC ATTACCAATT
156241 GGACCAAGAG TCCAGGTATG GAGCCAACAT GCAATGTTGT TGTTGACTGA GCTGGCAGAG
156301 CACTGGTCAT AGTTACGGGA AAAGAAGGTC TCCAATGAGA CATACTTAAC AAAATATATG
156361 AACTTGCCAT ATACGTGGAG AGTTCTGGTG TGTATATAGC CTTCTCTCAC CAACCTAGCA
156421 ATTGTCTTCA TCATCATTAT AATGCTATCA GAGCAAAGAT GACAGCTAAA TTTTTTTGTC
156481 CCTTTCTTCT TCTTTCTCTT CCTTCCCCTC CCCCACCTCT TTCTCTTCCT CCTCCTCCTT
156541 CATCTCTCTT CTTTTTTTTT TTGAGATGGA GTCTTACTCT GTCGCTCAAG CTGGAGTGCA
156601 GTGGCACAAT CTCAGCTCAC TGCAACCTCT GCCTTCTGGG TTCAAGCAAT TCTGCCTAAG
156661 CCTCCAGAGT AGCTAGGACT GCAAGTGCAC ACCACCACAC CTGGCTAATT TTTGTATTTT
156721 TAGTAGAGAT AGGGTTTCAC AATGCTGGCC AGGCTGGTCT CAAACTCCTG CCCTCAAGTG
156781 ATCCTCCTGC CTCGGCCTCC CAATGTGCTG GGATTACAGG CGTAAGCCAC TGTACCCGGC
156841 CTCCTCCTTT AATAGACAGG GTCTAGCTCT GTTGCCCAGG CTGGGTACAG TGGCGTGATC
156901 ATAGCTTACT GCAGCCTCGA ACTCCTGGGC TCAGGAGATC CTCCTGCCCT AGTCTCCCCA
156961 GTAGCTGGAA CTACAGGCAT AGCACACGGG GCTAATAAAA TTAATTAGGT GATAAAATTC
157021 ACTGCCCACT GATGACTAAG CTCTTTGGAC ATAAAAGACA CAGACCTTGA AGGAAAATGT
157081 GTCTACTTAA TTTTGAAACC CTATTTATCA AAAAACAGGA TGAAAATGCA AAATGCCATC
157141 CACATGCCAG AAGATATCAG CTATAATAAG TTCCCATAAA TCAATAAGGA AAAGAACCCA
157201 ATAAAAATTA TTAAACCACA GTAAATCATG GGTAAATCAC AGAGGCCTGA AGGGCTAATG
157261 GACATACAAA AAGAATCTCA ATCTCACTAG TGAAATCAGA AAAGCACAAA TTAAGTACAC
157321 AATTAGGTAC CATTTTAAAT CTGTAAGACT GTCAAAATCA TAAATTATAT AAGTAAAGAC
157381 TCAGGGAGTT TTGGAGGAGT GAGAGCTCTT ATATTGCTTG TGGGGTAGAA TTGAACAAT
157441 TTCAAGATCT GTAGTATCTG GTAAAATTAT GATATGCATC CCTCACACCA GCATGTCACT
157501 CCAAGGTATC TCCCTGGAGG GAACATTTAC GGGACACAAG GAAGCATGGA TAAGAATGTT
157561 CACAGTAGTA TTGTCTGCAA CAGCAACAAC AACAAAAAAA CCCAACTACA CACAACTTCA
157621 ATGCCCAGTC CACAAGGCAA TGGATTAAAT AAACTTCAGG CCGGAGATGG TGGTTCATGC
157681 CTGTAATCCC AACACTTTAG AAGGCCGAGG CGAGAGGACT GCTTGAGCCC AGGAGTTCAA
157741 GACCAGCCTG AACAAAATAA AGAGATAGTG TTTCTACAAA AAATTTTTAA AAAATTAGCC
157801 AGACGTGGCA GTGCTTGCCT GTGGTCCCAG CTACTGGGGA AGCTGACGTG GGAGGATTGC
157861 TTAAGCCCAG GAATTTAAGG CTGCAGGGAG CCATGATGGG GCCATTGCAC TCCAGCCTGG
157921 GTGACAGAGT GAGACCCTGT CTAAAGAGA TAAGTAAATA ACAACTTTGC ATTTTCTGCC
157981 ACATTGCAAA ATGGTGAGAG AGTGGTTTCT AGACTCTAGA CTCTTTCTAT GACTACCTTC
158041 TAGTTATGAG ATCCTACAAC ACTCACCTAA CCTCTCTGTG TCATATTTCC TCCTCTATAA
158101 AGCAAAAATG CCCCATATAG AGAGGACTGT GATATAAAAC AAGAACCAAG AAAAGTAAAG
158161 CTTTTCTAAT CTGTCACAGA CTAAAGAGTG CTCAGTATAT GTGAGTCATT ATTCCTGGTG
158221 CTGGTAGGAG TGTATGTTAC AACTTTGAGT CAAGTAATAT GGTACCATAT ATTAAGATTA
158281 ACAACAACCT CGGCAATCCC AGTTTGGGGT ATGTTCCCAA AAGAAATGAA AGCACCAGGA
158341 TATAAGGATG CATGGACTAG AAAGTTATTG TAGCAACATT GTAATAACTA AGTTCTAAAA
158401 ACAGCCTGAA GCTCCATCAG TAGGGATATG GTTACATATA TTTATTATAT TCTTATGGAA
158461 TATTAGACAT AAAAAGTAAC GAGTAACATA GAAGAGACAG TGTATATATG TTACGTTTGT
158521 ACAAACTTAG GGAAAGATAT AGATCACCCT ACCTAGAGAA GTCAGATTGG AGACGGGTGG
158581 GAAAAACCTT GAACTTTCTC CTTATATCCT TTATATTGTT TGACTGATTA AAATGTATTT
```

```
158641 GTTGCATCTG CTTGAAGGCA ATGTAAAATA AAATAAACAT ACATTTAAAA ATAAAAATAA
158701 AATTTATTCC TATCACTTTT GTAATAAAGC TGGGCACAGT GACTAACACT TGTAATCCTA
158761 GCACTTTGGG AGGCAGAGAC AGGCAGATCA CCTGAGGTCA GGGGTTTGAG ACCAGCCTGG
158821 CCAACATTGT GAAACCCCAT CTCTACTAAA AATACAAAAA TCAGCCAGGC ATAGTGGTGC
158881 GTACCTGTAA TCCCACGCTA CCCGGGAGGC TGAGGCGCTG AACCCAGGA GGCAGAGGCT
158941 GCAGTGAGCT GAGATTGCGG CACTGCAAGC CAGCCTGGGT AACAGCGAGA CTCCATCTCA
159001 AAAAAAAATT TGAAAAAAGA AAAATTTTAA TAAACAGTGT TTAAGAGGGG AGAAATATTT
159061 AGTTAAAAGA TAAGCCCATT TAAGAAATAG TTTCACTTGA CCCGGAAGGC GGAGCTTGCA
159121 GTGAGCCGAG ATCGCACCAC TGCACTCCAG CCTGGGCGAC AGAGCGAGAC TCTGTCTCAA
159181 AAAAAAAAAA AAAGAAAGAA AGAAAGAAAG AAATAGTTTC ACTTGAACCA TATTATGATT
159241 CCTTCTGTAA AAGATGAGAG TAGGCAAATT GACTCAGTGA AATCCCAGCA AAACTTACAC
159301 AAAGTCTTGT TCTTCCTTCC TGTCATCTGT ATAGGATGAA ATACAGAGTG CTTTTGGGTT
159361 TTGTTGTTGT TTGTTGTTGT GTATTTGAGG GGAACACAGG TCTATAATTC CTTTTCTGAA
159421 ATCCCTGGAA CAAAATGGGC TTTGCCATTC AAATTAGTTT AGAAGTTATA AAGGCAAAAA
159481 AATGCATATA CTCTAAAGTT CAACCCCATC ATGGCCTAAG GCAGAGCCCT GTAATCAAAT
159541 TCATCAATAT ATCTGCAGCA AAACATTTAT TCAAATTAAG TGGGATAAAT AAAGACTTTT
159601 AAATAGTCTC ATCTCAGTGC CGTTCAGGGT TGGCCACTGT GGAAGACAGA CTCAAGGGTG
159661 GCCTTCTATG ATTCCTGCCT CTTGGTGTTC ACACCCTCGT AAAATTCCTT GTCTTTGAGT
159721 GTGAGCAGGG CTTATGAATT GCTTCTGACC AATAGGATAT GGCAAAGATG ATGGATATA
159781 ATTTCTATGA TTACGTTTCA TTATGTAAGA CTCCATCTTG CTGGCAGATT TTCTCTAAAG
159841 AGTCTGTCTC CTGAGCTCTC TCTGAAGAAA TAACTGGCCA TGTTAGAAGC CCATGTGCAA
159901 AGAGCTGAGG GGTGGCCTGT AGAAGCTGTG GGCAACCTCC AGCCAACAGC CAGAAATAAC
159961 CAGGGCCAAA GTCCTGCAAC CATCAGGAAA GAAATTCTGC CTGCTACCTC AGTGAGCTTG
160021 GAAGTGGATT CTTCCTTAGC CTAGCCTCCA GATAAGAACA CAGCCTGACC AACACCTTAA
160081 CTGCAGCCTT ATCAGACCCT AAGCAGCAGG CCCAACTAAG CTGTGCCCAG ATTCCTGAAC
160141 CACAAAAATT GAGATAACAT ATCAGTGTTG TATTAAGGTT CTAAATTATG GTAATTTGTT
160201 TGTACTAATA GATAACTAAT ATAACCACCA AATCATTTCA GGTTAGGCCA GATTTTTGTA
160261 GCCAAATGAA TCATGATAAA ACTTTCCATT TTCAGGGGTT TTTTTGATTT TGTACTTACG
160321 GATACAAATT TGTGAAAGTA TAGTCAGCAC TGATTTAAAA AATCAAGGGA GCAGGAAACT
160381 CAGTAAATGG TTCTAACATT TTGGAATCTG TAAATTGGTT GTAACATTTG TCATCTGTGT
160441 TATCTAAGTC AAGTTCCTAA AATATGTGAA TGATAGGTTA TCATACTCAC CTACTTTTCT
160501 TGCATTGCTC TAAGAGTTGG CTGAGCTATT GATAATAAAC ACTATGATCA GATCTAATAC
160561 CATGATGTGC TATTATGATC ATGTGTCAGT CACAGGGCTA AGCACTTTGT ACATGTTGAT
160621 GCATTTAATT TTGATGATAA CTCAATGAAG TAGGAGCTGT TAATATTTTC ATTTTTCAGA
160681 GGGGGAAACC AAGTCACTTG GAGTAACATG GCTAATAAGT GAAAGAATAA GAATTTGAAA
160741 GGTTTGCACA GATAACCAGA ATGCAATGCT CATCACATTC ACTGAGCAGT GAATCATACT
160801 AACTAGAGAA AGTATGAAAG CTCTACTGAA ATTAACTAAA CAACCTCTCT GGCTGTGAGC
160861 CTGCCAAGGG ACAGGTGGTA AACTTGGTTA CTGCATAAGG CCCCTTCTAT CCACAGTATT
160921 CAGGAATTCT TTAGTGAACA TACCTTGATG ACTCCTTAAC ATTTTCTTCA CATCGAAGTA
160981 AAGCTTGGAA ACATTGCACA TAGTATGAAG TTCCAAGGAG ACAGCCTCTG ATGTTTCCAG
161041 CTTCACAGCC CAACTCCTAG AATAAGCAGA GGCGAGAGAT TTCTTCAGAG GTGCATTCCA
161101 TTCATTTCTA TATACGCACA CCCCTCCCCT CCTGCATTCA AACAGGACTT ACCTGCTCAA
161161 AGTGTCATTC ACATTCTATA AAGAAACAAA AAGAAAAGGT GAGCATGGGA ACATCGGTAT
161221 TTCATGGGGC TTGTCATGCA GGGCTATTCT TCTTTGCTTT ACCCGAAGAA GTAAAGAGAG
161281 TTACCCTAGT CTTAGTCTTA GATATTGATG GATACTCAAA CAAAGTAATT CCCACCAGTC
161341 TTAGGTATTG ATGGATACCC AGATGGAATA ATTCCTACCA GCTTCTGGGA GATTCAGCAT
161401 GGCAGGATGT TTATCAACAT TTGCATCTAT TCTCATCCTT GCTGAAGTCT GAGGGCCAGG
161461 AGCTTTGTCC ATGCTCCCTC TGTAAGGACT AGCTTTTGGT GATCGGATTT CCTTCACAGT
161521 GAGCCCAGAT TAGAGAACAC TTATCATAAA GGTCCTTAGT GGTGAATCTG TGCACAGCCC
161581 TGAGACTGGG CCACTGCCAC TAAGATGGTG GTAGCAGGTA TCACACAGTG GTAAAGCAAT
161641 CATGCTATAC ACTCAGCCTT ACAGTATAGT CACCAATCCT GTTAGTTAGA ACCAGAATTA
161701 ATGGCTCCAG ATGTTTATCT TCCTACAGAT AAAGCTGTAG ATTGTACCAT AACAGCTCTG
161761 GAGCAAGGGT TCTACAAGCA AATCAGGGAA AAGGTTATCA CTCATTTGG CTGCCCCACT
161821 TCATCACCCA TCAGTCACCT AGTGGAGTAT TCAGGAGAG AGTCAACAAC CAGGGTTCTC
```

```
161881  TGCACATGGG  CCAAGGAGGC  AAACAGTGGT  AAATGTTATC  CCGTGGTTTC  ATTTGGCCAA
161941  GCTGTGTTCC  CTCAGAAGTT  TATTTTTCTA  ATTGACATAA  AGGTACCCTA  TAAATTAGTG
162001  AAGGCCAGCC  TGATGGCACT  GATGTACATC  TAAAAGAAAC  ATTACTTTAT  CTTCCCATGC
162061  TTCCTTACCA  TTCTCCTTTA  ATAGCACTAT  AACATACCTT  TTTTCCCTAC  TCCAAGTACA
162121  CAGCCTCACC  TGCAGCAATT  TCTGGGCTGA  GCCCTGACAT  TTTTCCTCCA  GTTCCAGGAT
162181  GTGGCTCTTG  AGTTCATTGC  TCTTCAGCCC  CAGACCAGCC  TCATAGTCCC  TCAGTCTACT
162241  CAGAGTCTGT  TGTTCTTCTT  TCTCCAGCCT  CCAGAGATAA  GACTTCTCTT  CCTCATGTAG
162301  GAAACACTGG  AGATTCTTAA  AGTCAGACCG  GATTTTTGT   CTCTGAATCT  GTACCTTCTC
162361  CTGGAGTCAA  GAAAGTATGG  TCAAAGGTG   GAAGTAAACC  AAATGTCCAT  CTATGGATGA
162421  ATGGATAAAC  AAGAATGAAA  GTCTGACACA  CGCTACTACA  TGACAAGCCT  TGAAGACATT
162481  CAAGCAAAAT  AAGCCAGAAA  CAAAAGGGCA  AATATTGTAA  GACTTTGCTT  ATACAAGGCA
162541  TCTGGAGTAG  TTAAGTTCAT  AGAGACAGAA  AGTAAAATAG  TGGTTACAAG  GTGTTGGCAA
162601  GACCAGAAAA  TGGACAGTTA  TTGTTTAATG  GGTAGTGAGT  TTCAGTTTAG  AAGATGAAAG
162661  ATGAAACTGA  GTTGCAGTTT  GGAGATGGGA  ATGGTGATGG  TTGCACAACA  ATGTAACAAT
162721  GTAAAAGCAC  TTAATTCTAC  TGAACTATAT  ACTTAAAAGT  GGTTAAATGC  TTAAGTGTTA
162781  TATATATTTT  CACACAAACA  CACACACACA  CACAATCAGC  CACTGGGACA  TTATTTTCTC
162841  ATGAGTCACT  GAAGCTGGAA  GAATGTCCCC  AGTTTCCTGC  TGCAGAGTCA  TGTGTGGGAG
162901  GCAGGCACTC  AGATGTGGAA  GAGGTTGCCT  CAGATTCCTT  ATAGTCACCC  AATTAATTTT
162961  CTTGTTCTTC  AGCCAAGACA  CAGGAGAAAG  CTGGGTTAGG  AGTGCTAGAT  AATTTAATTG
163021  TGAAACTAGG  GCCAAGTTCA  AACACTTTAT  CAGTTACAAG  GATAAAAAGA  GGTTTTTACT
163081  TATGATTTAA  GAAGTTAGAT  TTCTGAGTTG  GAGCGATTTT  CTTGAAGTAA  AAGCTTATAA
163141  TGAACATCAC  CCAGACTGGA  TTTTAAGACA  ACCAGGCTGG  TAAGAGGGTC  CATAATTCTT
163201  GGCAGGGGGA  GCTTTGAGTG  TGACAGGCAT  TTATTATGGT  TAACTGAGAA  ATACTGTTCT
163261  ACTACCCTAG  GGTCATCTTA  AGCATTCCTA  TGTGTAAGAC  TGACAGAAAT  CAAGTGAAAC
163321  TCTCATCTGA  GGAGATGTAA  AGTTGCAATT  TCCATTAGTG  CTGTCTAAAT  TAATGCAGTG
163381  GGAGTGTGTA  TTCAGGGCAA  TTTGAATCTA  TGTTCTTGGA  TTGCAGTCTT  CAAACTTGGC
163441  CCAAATAAAC  TCTCTACTTA  TCTTAAAAAA  ATAAAATTA   AAAAATAAAA  ATAAATTCAT
163501  ACAGTGTTTT  GATGACTATG  ATATAGAAGA  AGGGTCTTTG  ACTTAGGATG  AGGTGGAATT
163561  TTTGTGTAGG  AGACAGGTGC  AGCTTTAACT  CTTGTATAGA  CGGGTTTTCA  TATATGTTAG
163621  TTACAATCAA  GGTCTTCCCC  ATTGCCCAAG  ATCCTAGAAA  TGGGGGAAGT  AAGAGTGTAC
163681  TCAGGAGCTC  AAGAGCAACA  TCCACAAACA  AAGATCAGGG  TAGAGGTTAG  AGAGGACTCC
163741  TGAAAGAGAG  AAAATTGGTA  ATCAGCTTGT  GGGATTTTAC  TGCAAGCTAG  TGAATTATAT
163801  AAATATAAAG  ATTGGTGCAA  AAGTAATTGT  GGTTTTTGCC  TTTACTTTAA  TGGCAAAGAC
163861  CGCAATTACT  TTTGCACAAA  CCTAAATATT  TCCATAAAAG  AATGTGGCTC  TGATAATGTG
163921  GAGGTTAGTC  AGCCACGGAA  ATAATCTGAA  AGTTTGTAGT  TGCAAGTGTG  TAGGTTGTTG
163981  CATTACTTGT  GATGTACTTA  TAAATCAAGT  ATAGGCCGGG  TGCAGTGGCT  CACGCCTGTA
164041  ATCCCAGCAC  TTTGGGAGGC  TGAGGTGGGT  GAATCACGAG  GTCAGGAGAT  CAAGACCATC
164101  CTGGCCAACA  TGGTGAAACC  CCGTCTCTAC  TAAAATACAA  AAAATTAGCC  AGGCATGGTA
164161  GCACATGCCT  GTAATCCCAG  CTACTCAAGA  GGCTGAGGCA  GGGGAATTGC  TTGAACCCGG
164221  GAGGTGGACA  TTGCAGTGAG  CTGAGATCGC  ACCACTACAC  TCCAGCAAGA  CTCCATCTCA
164281  AAAAATAGTA  ATAATTTAAA  AATAAATAAA  TAAATAAAGT  ATATTTCTTT  CATCAGCTTC
164341  ATGAGCTAGA  GTAGTATGAA  TTTCAATCTG  GAGTGATCCT  GTTTTCTAAG  TGTTCACAAA
164401  GCTTGGTTTC  TGTACCTGTA  AAGTTGAGAG  CCAGATGCTC  CACTGTGGTA  AAAGTGCCAG
164461  GGTAATGAGT  TGAGGCCTGC  AAACCAGGTT  TATTTGACG   TATTTAAAGT  TTGAGACCCA
164521  CTCGATGCTT  TTTCTAGGTA  AATAGTCATA  CTAATTCTGC  TTCTTCTGAC  TGAAGTATCA
164581  GGAATCCCAG  CCAACTACAG  TTTAAAGATG  GAAAGATTGG  TGCTAAATAC  TCATGGATGT
164641  AAACCTGGAA  CCAGGGGCAT  AAGTACAAAT  AATGGTTTCT  TCCTTGGGTT  TCATTTTTTC
164701  AATCTGGTTT  AGTGAGAATA  AATCCTCATT  GTGCTTTTCC  TCAATCATCC  CCTATGCCTA
164761  AGCTCTAGAA  TGGAAAATAG  CTTGAGATCA  ATGAAGTCAG  ATTCTTACTT  TCCATTTAGT
164821  TATTCGCATT  GCTGTGGACA  GCTTCTGCTC  CGTACATCTG  TCTTCAAGTT  GCTTCAGTTT
164881  TGTCACAGCT  TTCTGGAGCT  TTTCCTGAAG  GAAAAATTTG  ATAAGTGAAG  CCTATTCAAT
164941  TTGACTCTTC  ATTAGGGACC  TAGGGGGAAT  CCCAATCTTC  TAAGATATAT  TTGAATAATA
165001  GTGAATATTT  ATAGAGTCCT  CATTGTTTTT  TGCTAGAGAG  CATGCTAAAG  GCTATATGTG
165061  CAGGAACATA  CTGATCCCCT  TGGCAACCCT  GAATAGTTGG  TAGGATTTTA  AACTTCATTT
```

```
165121  CTGTGCTGTA  GAAAATGAGA  CTAAGAAAGG  GGTAAAATAA  CTTGCCCAAA  GGGCTATGAC
165181  TGCCAGGTGG  TGGAGCAACA  ATTGCAATCT  CATCTGCTGA  CCCAGAGCCT  GAGCTATGTC
165241  CACCACTAGA  GTCCTGCCAG  GAAAAGTTG   GATATAGAAC  AAGGTAATCA  TCATCTAAAA
165301  GATTTTGTAA  AACAACATGC  TGAACCAAGC  AAAACCAATA  CCAGTGTTTG  GCACACATGA
165361  AATTTTGTGT  CTTATGAGTC  AGGAAAAATC  AGGATGCCAG  CTGGTTATTA  GAAACAGTTC
165421  ATGGAAGAGG  GGAATTCTGG  TATCTTTTGA  ACAATGGTAT  CATGAATCCA  ATTTAAAATG
165481  ATTTAGTATT  CATGTCAAGC  TTTTAGCTTA  TTCTTCAAAA  CAGTTTCTCA  TATTTCTATT
165541  GAAAGTGATT  TGAAGCTGAC  CCAAATTGCT  AATTGTAGTC  AATGCTGAAA  GAATTGTCTC
165601  CTGTCCTCTG  TAAACCCAAC  AAGTATACTC  ATTCATTCTC  GAGTGTTCTC  AGGAAAAGGT
165661  TCTATGTAAC  TGTTTTAGCA  AAAGATGACA  TTGTCCTTAC  TATATGCCAA  GTGCTATTCT
165721  ATGCATTCTA  TATTTTAATG  TCCTCAAAGC  TTATAACCAC  CTCCTGTGTA  TGTGTTTTAG
165781  GGAGGGAGGA  CACTGCTATT  ATCCCCATTT  ACAGATGGAG  AAACCAAGGT  GTGAAGACAT
165841  TAAGTAACGT  GCCCAAAATT  GCCCATCTAG  TAAGTGACAA  AACTCAATTT  CAACATAAGC
165901  TGGTTCCTTT  TCTTACTACT  TGGTGGAAAA  GTAATTCAAA  TGGGAATATG  ATCATCGCAG
165961  TTATTAGCTG  CTCCATGGAG  TTTAAGGAAG  AGCTGCCATG  AGCTGAGTGG  TGGTCATGAT
166021  TGACATGTCC  TTAGAAGGAC  TTAGAGCCTT  CATACAAGAC  CACCTCTGCC  TCATGGAGGA
166081  CAGAATAAGG  AGCCTGACAC  TGGAGACAAC  ATTTTCCTCA  AATTTAGGCA  GGACAGAGAA
166141  GGAAAAAGGA  CATCAGGACT  ATGCCATTC   CTCCATGCTG  CCAACAGCAA  AGTCCCACCT
166201  TCCTTAATAT  GCTTTCTGGC  AAGAAATCTG  GATGGTACAC  AAAACCTCTC  CCTCTGCTTC
166261  ACCTTCCACA  ACCAAGCATT  TCCAAATCTT  TGACTCTTCT  TCCTGAATCG  TGCTTAAAAT
166321  CTGCCCTCTC  CTCCCTTTCT  TATACGGATA  GTTTGAATTT  TACTCCTTGA  TATTCCTTTT
166381  ATCATAGACA  TGCCACAGTA  GCTGGGCACA  GTGGTTCATG  CCTCTAATCC  CAGCATTTTG
166441  GGAGGCTGAG  ATGGGAGGGA  GACCAGGGGT  TTGAGGCCAG  TATAAGCAAG  AAAGGCAGAC
166501  CATGTCTCTA  CAAAAAATAA  AAAATTATC   CAGGTATGGT  GGGGCATCCC  TGTAGTCCTA
166561  GCTACTTGGG  AGGCTGAGGT  GGGAGGATTG  CTTGAGCCCC  AGAAGGTTGA  GGCTGCAGTG
166621  AGCCGAGATT  GCACCATTGT  ACTCCAACCT  GGGATACAGA  GCAAGACCCT  ACCTCAGGAA
166681  AAAAAAAAAA  AAAAAAAAAA  AAAAGTAGAG  GTACCAGAGT  GATATTTTCA  ATGTCACTGA
166741  CCCTTCATTC  CCCAAATGAA  AATCCCCCAA  TAGGTGTTCA  ATTTTTACGT  GTCCTTCAGG
166801  AGTTACTTCT  AAGATGAACC  ACTCTCTACC  CTAAATGTCC  CTCCCCACCA  CCAAAACCAG
166861  GGACCTCCAG  GCAGACATTT  TTGATGGTTT  GTTTTCTTTA  CTAGACTGTA  GATACCTAAA
166921  AGGTGATGGG  TCTTTCTTCC  CTGTTTTCAG  GCCCTACTGC  ATGGCTTTAC  ATATTGTGGT
166981  TTTTCAAATG  ATATTCATGG  TGTGAAACAA  GAAAAAATGC  GGGTGTTTGG  TTTGAGAACA
167041  ACCTGTTCTA  AAGCAAAAAG  AAATTCATCA  TAACACAAAT  GGATAGAGAT  AAGAGTCCAA
167101  CCATCCCATT  GAAGGTCAGG  ATGGACAGTC  TAGATAATTG  AGCAAGAAAT  CATCATAAAC
167161  TATTTTTCAG  AAGAATGACA  TGATGAAAGC  TGTATTTCCA  AGTCATAATG  TTAGGTTTCA
167221  AGTTAAATCA  TCTCAGCTCC  TGGGGAGCAG  GATAAGACTT  GGTACTTACC  AAAGCTCCCG
167281  GGCCCACACA  CTCACCTTGT  AGCCCTGGCA  TACGTCTTCA  ACAAGAGCTG  TGGTGTGCCC
167341  TTTGTGCTGT  GGTGCCCGCT  CACAGCGCCA  GCAGATGAGC  TGCCCCTCGT  CTTCGCAGAA
167401  CAGGTGGAAC  TGCTCTCCGT  GTTCCTCACA  TGACATTTCT  TGATCCGTCT  CTTTGAGGGC
167461  TTCAATGAGG  CTTCCCAGCT  GCTTGTTGGG  TCGGAGGCTA  TCCATATGAA  ATGGAGCCCG
167521  ACACTGGGGA  CAGCAGAATG  TCTCCTGCCT  CAGTTGCTTT  TGGCTTGGGT  TTTTAAAGAA
167581  GTCTGTTATA  CACAAGTGGC  AGTAGCTGTG  TCCACAGTTG  ATGCTTACTG  GGTTCGTCAT
167641  CAGGCTCAGG  CAGATGGAGC  AGGTGGCTTC  CTCCATCATC  TTCTTGGTGC  TGGTGGTTGA
167701  GGCCATAGCT  TTTATTGAAA  AGCTCCAATA  TTGGCTCTAG  AGATGGAGAT  GAAGCAGCCA
167761  GAATTTTCCA  CCGTGATGAA  AATACACCTC  ACCTGCACCT  CTATGTGATG  AGCTGGCTGC
167821  AACTGACTTC  CATAGGTCTT  GAAGGTTTTC  CTTCCAACCC  CTATTATCTC  ATTTTGTATT
167881  GAAGAAAGA   GGACCTAAAA  GGAAGAAGTT  GAGGCTGAGG  TTGTTTGGGC  CACGTTTGAG
167941  AACTGCAACC  CAAGTGCAGA  GTTTCAAGTT  GCCCTCATTA  GCAAGCAGTT  ACAAGTGGTT
168001  GTTTAGAGGA  AAAAAGCAG   TTTTAAAGCA  GTTTTAAAGT  TGTTTGCCAA  GAATTTACAT
168061  TAAAATAGCA  TAAGCTTTTG  ACTGGCTATA  CATTGTTCTT  TGTATTACAA  ATCTCGGGAA
168121  TATGTAGGTA  ATAGATGAGG  CAGCCAGTCA  GGAACAAAAT  GCTTTTAAAC  ATGGGGTCTT
168181  AACTGAAGAC  CTATACTCCT  GCCTCACTTG  TCCTGATAAA  TTTTGCATAC  CTCACATAGC
168241  TCAGACTGCT  CTAAATTATT  TCATTATTTT  TCTTTTCTCA  GTCTTCTAAC  TTTTTTTTTT
168301  TTTTTAATG   AGACGGAGTC  TCACTCTGTC  ACCCAGGCTG  GAGTGCAGTG  ACGCTATCTC
```

Figure 1

```
168361 GGCTCACTGC ACCTCCGCCT CCCGGGTTCA AGCGATTCTC CTGCCTCAGC CTCCCGAGTA
168421 GTAGCTGGGT CTACAGGTGT GCACCACTAC GCCCAGCTAA TTTTTGTATT TTTAGTAGAG
168481 ATGGGGTTTC ACCATGTTGG TTGGCTCGAT CTCTTGACCT TGTGATCCAC CCGCCTCAGC
168541 CTCCCAAAGT GCCAGGATTA CAGGCATGAG CCACCGTGCC CAGCCTCTTT TTCTTTTCTT
168601 ATAAGACAAG TTCTCGCTCT CTTGCCCAGG CTGTAGTGGA GGGCAGTGGC ATGACCACAG
168661 CTCACTGCAG CCTCGACCTC CTGGGTTTAA GCAATCCTCC TGCCTCACCC TGGCAGAGTG
168721 GCTGGGACTA CAGGTATGTG CCACCATGTC CAGCTAAAGT CTTCTCTCCA GAAAGAAGAA
168781 ATGCATTGGA ATTTAGAGGA TACACAAACA TCTAGCTGTA TAGCTAATAC AGTAGCCACT
168841 ATCATGAGTA GGAATTTAAA TTTAACTTAA TAAAAATTAA AATGAAAAAA TTCAGTTTTT
168901 CTGTTCCAGT TGCCACATTT TGATTGCTTA ATAGTTGCAT GTGACTAGTG GCTACATAAC
168961 AGCCTCAATA TACAACATTC TGTTATCACA GAAAGTTACC TTGGACCAAG TGCTGGGAGA
169021 AGCAATGCAG GCTTCCTCAC AAAAGCTGTA AAGAGAGAA CTCAGGGAGT GTGAAACTCT
169081 TTCCTATTCT AGTTAACTTC AAGAATAATT GTTACCAGGC AGCACGGTG GCTCACGCCT
169141 GTAATCCTAG CACTTTGGGA AGCCGAGGCG GGCAGATCAC CTGAGGTCAG GAGTTTGAGA
169201 CCAGCCTGAC CAACATGGCA AAACCTCATC TCTACTAAAA ATACAAAAAG TTAGCTAGAT
169261 GTGGTGGTGC ACACCTGTAA TCCCAGCTGC TCAGGAGGCT GAGGAAGGAG AATGACTTGA
169321 GCTCCGGAGG GGGAGGTTGC AGTGAGCCCA GATTACACCA CTGCACTCCA GCCTGGGTGA
169381 AAGAGCGAGA ATCTGTCTTA AAAAAAAAAA AAAGAATAAT TGGTACCAGA ATTACTCTTT
169441 GTAATTAGTA GTAACACTTA TGCAATTGGG TGATCTGTGA CAGATTCCAT TGAAGGAGTA
169501 TGGGGAGCTT CACCCCAATA TATGACTCCC TGGTATAATG AGTATTTTGA ATTAAAGGCC
169561 CTTAGAGATC AGCAGATGCT GGAAGAGACT TTTCCCCTAT CTACATAAAG ACCAGTCACA
169621 CTAGACAAGA AGAACAATTG TTTTTCCTTC CAACCCCTAT TATCTCATTT TGTACTGAAG
169681 AAAAGAGGAC TAAGAATGTA ACCAGACCTA ATCAGACACT TTCACAAAAT AATGTCTGTC
169741 TCTCAGGCTC ATTCATTTTC CAAAGAGAAC CATTTACAAG TTAAACTCTG TTCCTCCATT
169801 CATTCATCCT CCCAAATATT CATTTATTCT CCCTAGTAAT CATTTACTGC CCCTCAAAGA
169861 ATTACCTATA TTCTCCTGAT ATCACCCTTC CCCTCTGAAA TAAATATGTA TACATGTATA
169921 AACGTTATAC ATACATATTT ATACAGTATA CATACATATT TATACATACA TACATATGCA
169981 TACATATTTA TATTTATGTA TTTATACATA AGTATTTATA AATAAGGCTA TATAAGTATC
170041 TACCCCCATT GGCAGAGGGG GTAATCACTC TGTGATTCTA GCCCATGTAC TTGTTAATAA
170101 ATTTGTATGC CTTTTCTCCA ATTAGCCTGC CTTTTGTGAG TCGATTTTTC AGTGAACTTC
170161 AGAAGGCAAA GGGGAAGTGT TCCCTTGGCT CCTACACCAT CATGACAATA AAATTTGACT
170221 CCACCTCGAC CCCCCCCATC CCCCACAAAG AACAACAACC AACACTGGTT AATAAGGTCG
170281 GTTGTTTTTT GTTTGTGTTT TTGTTGTTGT TGTTTTTGCT TTCAGGAGCA GAGGTATAAT
170341 AGGCAAAAGA AAGAGAAAGG AGAATAGTGA ATACCTCTTC TGCAGAGAGG GGTGCCTAAG
170401 TGGGACTTCC CTGGCTAATA ACGTCTTGCT AGAGACCCAA CCAGGAGGAT AATGGAAGCA
170461 ATCAAGGCAA CCAGAACAAC CAGAAGAACC GGTTTATCCT TTTTGTGCCC TCTCCCTAAA
170521 CTGAGGGAAT AAGAATTGGA AGAAGGCTG CAGAGCAGAG GGTTTGCTCC TGAGGAGCAG
170581 TTATTTCTAT GGGATCAGAG CTCCTGCAGA ACTGGGAGT TTACTTTTAC TATCTCTTCT
170641 CCAGGACAGG ACCTATCTCA AGAGACATGT TCAGAGTGAT TGCAACATAA AGAGTTTGCA
170701 GACCCAAGGA GGTAGGGAAG GCAGAAAGAA GATGGGGGAG GCCAGGGATA GGCAACAGAG
170761 GAGTGACCAG GAGCGAAAAA GCCTGCCTCT TCTGAGAACC TAGCTGGGCT CTCCCTGTAC
170821 CCCCGATCCC TCCCCCCCGC CCGCCCCCAC ACCCCTACTC CTGGGAGCTC CTCTAGGACA
170881 GGGCAGAGT CAGGAGGAAG TTTGAAGAGT GCCTAGAATA AAAAACAGTA ATTTAACTAC
170941 AATTACCGGG TAGGCTGTTT TCCTCTCACA ATTTGATCAG TCTCTTGAAG CCACACAGAA
171001 TTTCTTCTGA AGACGTGTAT TCCTTGGCAG GCTATTTCCT CCAGTGATAC ACCAGGCCCC
171061 TCTCTGCTGG GGTCACTGCT CTTCTGGGGA GATGGGGCTC CCCTCCTTCC AAGGCTCCAG
171121 GGTTCCTGTC CTGGGCCCCA CTCATCTAAG TTCTGAATCT TCTGAGATTT GGTGTAAAGT
171181 CTGGTGAAAG AAAGAGCAGG AAAGAGGTGA GAGCTGTAAA ACAAAGAAAG TCCTGACCAT
171241 TTTCAGAGTT GGAGGGGCCC TGCTGTCACG AAATATATTC CCCACCCCAC TTGCCATCAG
171301 TACACACTCA CATATCCACT GAGAAACCT TAGCCTGGAC CTTTTCCGTA ACCTTCACTG
171361 CTCAGACACT TACATATTCG CTGCTAGTCC CCTCTGTTGC TGCCACTTCC TGGGTCAGGA
171421 AGTTAACTCA GACCGGATTA AACTGAGAAG TGAAACTACT GTGGGAGGCG GGGCTCATAA
171481 GATTTAGGAG AAAACTAGTG ACGTTGTTCA TATCATTTGC ACTCCGCCTC TCCGGTAAAG
171541 GAGGGGGAAA CGTAGGAAGA AAATATCCTT CTTTTACAGC AATAAAAAGA AGGAACCAAT
```

```
171601 TAATAACCCT GTAAACTATC ATGTGACCCC AACACAGAGT ATCTAAAAAC AGGAAGCCTG
171661 CAGAGGTTCA GTTCACAGAC TCTGATTTGA GATCTTTCTA CTTTTGCCAC CAACTCCCTT
171721 GGGAGTCCTT AAGCCTTCCT AGCTGATGTT ACTTCTTTTG CTATTTATGG GTTGCTTGTG
171781 GTTCTATAAC TGCTCTGAAG GGTGTGGTGG AAAAAGGGGT GGTAACAGCA GTAGGACTCA
171841 TTGGCATCAC AAAATTCATC TGAGTCAGCT TTCTATTCTT CTCTGTCCCG TTCTGTGTCT
171901 TGTTTTTCTC CTTGCTGTCC TTCTGCAGGA CTCAGATCTT CTTCAATAGC GAGGGTCAGC
171961 CAGGATAGAA AATGGGAGTC ACTAGTGGCC CAGCAGTGAG TGCCCCCAGC TTAGAGCTGT
172021 GTGGGATCCC TGGGACCATC ACTCTGCTTT GTGCTTTGTG GAGAAAGGC TGTGGGGTCC
172081 AGGGTCAAGT CCTTAATGAC TTAGCTCCAG CTTCTCCACT TCAAAATGAA AGGAAAAGTA
172141 CTATCACCAC CCGTTAGAAT TATTATTTCA TGGGGAAAAA AGATGGATTA CTATCTCACA
172201 ATAAGAGCTT GTCACATTTA TAAGTCTCAG GTGTAAGAGG CATTTATGAT AACAACATAA
172261 TAAATGCTGG CTTAAGTAGA TGCAGTGGTC CAAGGGAACC AGTAAGGGGA GCTCAGGACA
172321 CAGGTGGGAG GAGAAATTAA ACTTGAATTC TGGGAGCCAC TGGCCTGTCT GGGCCCCTGG
172381 CCTGCCTGCT GACCCTGATA GCCAATGGAA CATGGAGTTT GGCCCAGCTG CAATCCCTCT
172441 GGTCCAACTA CTCAAAATAA AGGCAAGATT GGGAAACACG TTCCTTTCTT CCTATACCAA
172501 GCAGAAGACT CTTCAGCACT GCACCCTCCT GGGTGCTCAC AGAGCCTTCT GTTGTTTTGC
172561 CACCTACGAT TCATCATGCC CTGGCATGAT GGTTGCAGAC CCCATGCATA GCATGGGACA
172621 TTCTACTCCT GAGGCAACCA GCACACAGAG AGAGGAGAAA GAATGAGCCC CTGAATCCTT
172681 GGTCCCACGA TGAGTCCTTG CAGATATCTA CAACTTTCAT TGTTGTGGAT GTGACTCTGT
172741 ACCCAGGCAT GGCTCATTCC AGATCTGTCC TATTGTCAGA GGTGTTCAAA CCAGAATGAC
172801 TCCATTTTGA ATGGGGCTA GGTAAATAA GGCTGAGACC TACTGGGCTG CATTCCCAGG
172861 AAGTTAGGCA TTGTAAGTCA CAGGATGAAA TAGGCAGTTG GCACAAGACA CAGGTCATAA
172921 AGATCTTGCT GATAAAACAG GTTGCAGTAA AGAAGCTGAC CAAAACCCAC CAAAATCAAG
172981 ATGGCAACAA GAGTGGCCTC TAGTCATTCT CATTGCTCAT TATACACGAA TTATAATGTG
173041 TTAGCAAGTT AGAAGGCATT CCCACCAGCT CCATAGTGGT TTATAAATAC CATGGCGATG
173101 TCAGGAAGCT ACCCTATATA GTCTAAAAAG GGGAGGAACG CTTGGTTCTG GGAATTGCCC
173161 ACATCTTTCC CAGAAAACAT ATGAATAATC CACTCCTTGT TTAGTACATA ATCAAGAAAT
173221 AACTGTAAGT ATCTGTATTA GTCCATTTTC ACACTGCTGA TCCAGACATA CCTGAGACTG
173281 AGTAATTTAT ACCAGGAAAA AATGTTTCAT GCTCTTACAG TCCCACGTGT CTGGGGAGAC
173341 CTCACAACCA CAGCAGAAGG CAAGGAGGAG CAAGTCAGGT CTTACATGGA TGGCAGCAGG
173401 CAAAGAGCTT GTGCAGGGAA ATTCCTTTCT ATAAACCAT CAGGTCTCAT GAAACTTATT
173461 GACTATCATG AGAACAGCAG TATAAATTAC TCAGGGAAAG ACCTGCCCCC ATGATTCAAT
173521 TACCTCCCAC CAGGTCCCTC CCACAATATG TGGGAATTTA AGATGAGAGT TAGGTGGGGA
173581 CACAGCCAAA CCATATCAGT ATCCTTAGTC CAGAAGCTGA TGCTCTGCCT GTAGAGTAGC
173641 CGTTCTTTTA TTCCTTTACT TTCTTGCTTT CACTTTACTG TGTAGACTTG CCCCAAATTC
173701 TTTCTCACAC GAGATCTAAG AACCTTCTCT TAGGGTCTGG GTTGGGACCC CCTTTCTGGT
173761 AACACTATCA AAGGATCAGG AAAAGGAAGC TAGTGAATGC TAAAAAGGAA ACAAACTACC
173821 ATTACCAATA ATAACAGCAA GACAAAAGCA AACGGATTG TGACAGCTGT CCCATCTCAC
173881 ACCTGTTTCC CATTGCAGGA AGGAGGGGCT GGTTCATGCA CAGAGTGGCC AATATTAGAA
173941 GCAGAGATGG GGTGCAGATG AGACTTCAGG AATATGTTGA CAAAGGCAGG CCTAGGGAGA
174001 AATCAACCTG AACTATCCCC AAGGAGGAAT GCATTATCTC TAATATGTAA AGTTAGGCTT
174061 GATCCTGTGA TTATGGGATA TAGGAGTCCA AAGACTCACA ATGGGAAGTA GGTCACTAGA
174121 GTCTCCTTCA GAAGCTCTGT ACTGTGTGTT CCCACTGTGG GCAAGAGTCA GCACTCAGCT
174181 ATTCCTAGAA TGCCTTTCCT CAACTCCTTC AGATTTTGCC TCTCAACTAA CCCTATCCTG
174241 ACCACTTGTT AGCAAGTGTA CCCCTCTCTC CCTCCCAAAC ATTTTCAAAT CTATTTTGTT
174301 CCCATGGCAC TTATCACTGA ATATTTTACT AATTTATTTT GTTTAGTGTT TGCTTCCCTC
174361 ATGAGAATGC AAAGGGATGG ATTTTTTTCA ATATTGTTCA CTGATGAATC CCAGTAACTA
174421 GAATATTTCT AAGCATAGTG ATGTGCATTA AATCAAAGAG TAACTTTCTG AATTGCACTA
174481 AACACACATC ACAAGAGGTG TGTGCACATA TGTGCATGAT GCACGTAGTG TGGTGTGGGT
174541 GTTGTGTGGG GTATGTGGTA CTGTGTGTGC TGTGTGTGGT ATGTGATACA TAGTTTGTGT
174601 TAGTGTGATG CATGTGATGT GGTATGTGTG TGCGTGTCCA TACATATTAG GGGTGGCGGG
174661 GATGTTAATA TGTCAAATGG TACTAGAAAG TATCAGAACT CATGGTGCTT ACTGGTTTCC
174721 CAGAGAGCTG CTTCTCTCCC ACCTGTAGGA TATACTGATG GTTTGGACAG AGAAGAAATA
174781 AAAAGAAGGC TGTGACCTAC TGGGCTGAGG AAATAAAAAC GAAAGTAAAA GAAGAGCTGG
```

```
174841 GAAAAGAGAG TGGAGGGGCC AAGGGAAATT TCCCCTTTGG CTTCTGGGGA AACTTTGCTG
174901 AAAAATCAAC TCACAAATTT ATTAACATGT ACACAGGGAG AACCATAGAA TGATTATCCA
174961 CTTCCCAAGA GGGCTTAAAA GCTTATATAT TATCCTGGCA AAACAGATTA TGGGAGGGGA
175021 AGAAGAGAAA CTCTGTTGAT GGGATTACTG TTGCGGATTT TTGCTCCTTC GCTCAGCTAG
175081 GTCCGGGTTT TTGTCTCACA GCCAGGAAGA ATTAGGCATG CAGCCATCAA AGAATGAGTG
175141 GAGTAGAATT TATTAAGTGA AAGGAAAGCT CTCAGCAAAG ACAAGGGTCC TGAAAGCAGA
175201 TTTCTGGTTT GCTCTTCACA GTTAATACT AGGGCTTAAG ACTCAAATTC CTGACAACTC
175261 CACCCTGTCC TACCAGTGCA TGCAGGCCTT TAGACTGAGC TACTCCATAT TGATTAATTT
175321 CCTGAACTGT GCATGTGTTA AGGAAAGGAA TCATCCACTG CAGGCATGTT TAGGCAAGCC
175381 CCCTGTGCAA GTTCCCTTAT CTGCACAAAA CATCCGGTGT AAGCACTTGT GGGGCAGGTC
175441 AGAGGTTCTC TGGGTACCAT TCCCTTACTG TCTGCCTAAA GCAAGCTGGC CAACTCCTTT
175501 CATTACTAGG GAGAGTAAGT AGATCAGGGA ACAGAGATTA ACTTGAACAT TATCTTGTGA
175561 AAGTCCGTTC GGGCATGGTT ACATTCTTGG TCTTACAGGA AGGGTAAATA AAAATAATTG
175621 CTCTTTTTGG TGGGTCTGGA TCTTAGGTAG ATAAAGAAAC TTTAATTCCA CGATGTGTTT
175681 TGGTAGGGAT AGTTGGTGGC AGGGATGTCA GAGAGACTTT GAGGCTTCTT CAGTTCAATA
175741 TGACCAAGGG CCATATATTA GGGTATCAAT TTCTGAGCCC AACAAGAGC TTAGGAGAGA
175801 TGTGATAGCA TCACAGTGTG AAAGCAATTT TTTGTTTGTT TTTAGAGACA GGCTCTTGCA
175861 CTGTCACCCT GGCTGAAGTA CAATGGTACG ATCACAGCTC ACTGTAATCT TGAACTGGGT
175921 TCAAATGATC CTCCCATCTA AGCATTTCAA AGTGTTGGGA TTACAGGCAT GAGCCACGGT
175981 ACCCAGCCTG AAACTGCACC CACTTTCTGA TAAACTTTTC AAATGACTAA AGGGGAGAGA
176041 GTAAGCACTA CTCAGAGGTA GGAAGAAAGG ACACAGGATT ATAGGATTAA AACAACAACC
176101 ACCAAAAAAA ACCAGACCGG TGTGGTGGCT CACACCTGTA ATCACAGCAC TTGGGGAGGC
176161 TGAGGTGGGG GGAGTCACTG GAGGCCAGGA GTTCGAGACG AGCCTGGCCA ACATAGCAAG
176221 ATGCTGTCTC TATTAAAAAA AAAAAATACC TGCCTTGAGC TAATCAGAAT CATGGACCCT
176281 GACAAAGGAT GTCCCAAAGT AAGTCTTAGC ATTTTTTTTT TTTTTTGAG ACAGTCTCGC
176341 TGTGTTGCCC AGGCTGAAGT TCAGTGGCGT GATCTCGGCT CACTGCAACA GCTGCCTCCC
176401 AGGCTCAAGC AATTCTCCCT GCCTTCAGCC TCCCAAGTAG CTGGGATTAC AGATGCCCAC
176461 CACCACGCCT GGCTAATTTT TGTTTTTTTT AATAGAGATG GGGTTTTGCC ATGTTAACCA
176521 GGCAGGTCTT GAACTCCTGA CCTCAAGTGA TCTGCCCACC TTGGCCCCTC CATAGTGCTG
176581 GGATTACAGG CGTGAGTCAC TGCACCCGGC AAAGTCTTAG CATTCTTTAC AAACAGTTTG
176641 TACCCGTATC TCTAAAGGG AGTAGTGAAT TCACCCCAA AATGTGGCTT CCTGATATAA
176701 TGAGTATTTT GAATGAAAAA CTCTTAGAGA TCAACAGACA CTAAAGAGAC TTTTCCCTAG
176761 GTACATAAAA ATAGGATGGC CCCACCAGCG AGAACAATTG TTCTTTTCTC CCTCTCTGTT
176821 ATCTCATTGT GCATTATAGG AAAGACCAAG AATGTAACCA CACCTGAACA GACCCTTTTA
176881 TAAGATAATC AGTCTCTAAG CATCATTTAA ATTCCAAGGA GAACTATTTA CAAATTTATC
176941 TGTTCTTTGA TCCAATTAGT CTCTCCTGGT AGTTACATAT TGCCCCTCAA CAGAATTCCT
177001 CTTCTTCTGT TTCCCATAAC CTATTTTGCA AGGATCAAGC CCCTGTTATT TCTTCAACTT
177061 CAAGGTGGCA TATAAGCTTC TAAATTCCAC TGGGATATTG GTACTATGTG CATGAGGAGA
177121 ACCACAGAGT AATTAAATTG TAAAGCCTTT TATCTTATGA ATCTGCCTTT TTTTGTGTTC
177181 ATTTTTCAGC AAAACTTCCA AGGGCAAAGG TATAAAACAA AAATAAAATT CTAAAGCCCC
177241 CCAACCATCT GAATAGACTT TCTCTTCAGT CAGGCTTCTT AAAATGTAAC CTGAAAGACT
177301 GGCTCAGGCC ATTAAGGGAA GTGGGGGTTG AACATGCCTC ATTATTCCTC TCTGGCATTA
177361 ACATCAACAC AGCTTTTAAG TCTGATAAGA AACATTTTAC AACCTATTCT CTCTGAAGCC
177421 TGCTAGCTAA AAACTTCATC CCATAGTACA ACTTTGGTCT TCACAACCTG TTATCACAAC
177481 CTAGTGCTCC TTTCTATTAA TCCCAAATCT TTATACAAAC TCAACCAATT GTCATCACCT
177541 CCACCCCACT CCTCCGCTGC TTCCAGTTGT CCCGCCTCTC TGGACCAAAC CAGTGTACAT
177601 TTCTTAAACG TATTTGATTG ATGTCCCATG CCTCCCTAAA ATGTATAAAG CCAAGGTGCA
177661 TCCCAACCAC CTTGAGCGCT TGTTCTCAGG ACCTCCTGAG GGCTGTGTCA TGGGCCATGG
177721 TCACTCAAAT TTGGCTCAGA ATAAATCTCT TCAAATGTTT TACAGAGTTT GGCTCTTGTC
177781 ATGACACAGA TGACTGCTTC ACTGAAGCCT GCTCTGGAAG TGAGTGGGGG TTTTGCAAGG
177841 ATAATTTTCC CCGGATAGCC CCAGAAGCAG CTAGTAATAA TACACTTAAA GGTAGCTAAA
177901 ATGCATTGAA CACTTGTTTT GTGCCAGACC TATGTCAACA TTTGCTTTGT GCCAGGCTTA
177961 TGCCAGTACT CCTGATTTGT TAATACATTC TAAATAAAAA TTCTGGAGTT TCAAATATAA
178021 TAACTGAAAA ACAGAAAATA AATAAAAATA TATAATAACT GAAATAAAAA TTTACTAAGG
```

Figure 1 (Page 55 of 73)

```
178081 CTGGGGATGG TGGCTCACTC ACACCTGTAA TCCTGTTACC GGAAAGGGGT CCGTCCAGAT
178141 CCAGACCCCA AGAGAGGGTT CTTGGATCTC ACACAAGAAA GAATTCGGGC GAGTCTGTAA
178201 AGTGAAAGCA AGTTTATTAA GAAAGTAGAG GAATAAAAGA ACGGCTACTC CATAGGCAGA
178261 GCAGCTCTGA GGGCTGCTGG TCGCTCATTT TTATGGTTAT TTCTTGATTA TGTGCTAAAC
178321 AAGGGGTGGA TAATTCATGC CTCCATTTTT TAGACCATAT AAAGTAACTT CCTGACGTTG
178381 CCATGGCATT CGTAAACTGT CGTGGCGCTG GTATGAGCAT AGCAGTGAGG ACGACCAGAG
178441 GTCACTCTCA TCGCCATCTT GGATTTGGTG GGGAGCAGTG AGGATGACCA GAGGTCACTC
178501 TCATCGCCAT CTTGGATTTG GTGGGGTTTA GCCAGCTTCT TTACTTTTTT CTTTTTTTTT
178561 TTTGCCCAGG CTGGAGTGCA GTGGCACGAT CTCAGCTCAC TGAAACCTCC AATTTCTGAG
178621 TTCAAGCGAT TCTCGTGCCT CAGCCTCCCA AGTAGCTGGG ATTACAGGCA TGTGCCACCA
178681 CACCCAGCTA ATTTTTTATA TTTTTAATAG AGACGGGGTT TCGCCATGTT GCCTACGCTG
178741 ATCTCCAACT CCTGCGCTCA AGCCATCCAG CCACCTTAGC CTCCCAAAGT GCTGGGCTTA
178801 TAGGTGTGAG CCACCCCACC TGGCCTAGCC GGCTTCTTTA CTGCAACCTG TTTTATCAGC
178861 AAGGTCTTTA TGACCTGTAT TTTGTGCCCA CTGCCTGCCT CATCCTGTGG CTTACAATGC
178921 CTAACTTACA GGGAATGCAG CCCAGCAGGA CTCAGCCTTA TTTCACCCAG CTCCTATTCA
178981 AGATGGAGTC TTTCTTGTTC AAATACCTCT GACAAGCCCA ACACTTTGGG AGGATGACAC
179041 AGGAGGATTG CTTTAGCCTA GGAGCTCAAG ACCAGCCTGG GCAACACAGT GAGACCCCAT
179101 CTCTAAAAAA AAAAATACAA AAAAATTAGC CAGGCATGAT GGTGTGTGCC TGTAGTCCCT
179161 GCTACTCAGG AGGCTGAAGT GGGAAGATGG CTTCAGCCCA GGAATTCAAG CTGCATTGT
179221 CAGAGGCATT TGAACCAGAA TGACTCTATC TTGAATAGGC GCTGGATAAA ATAAGGCTGA
179281 CACCTGCTAG GCTGCATTTC CAGTATGTTA GGCATTCTTA GTCACAGGAT GAGATAGGAA
179341 GTCAGCACAA GGTACACATC ACAAAGACCT TGCTGATAAA ATAGGTTGTG GTAAAGAAGT
179401 TGGCCAAAAC CCATCAAAAC CAACATGGCC ACCAAAGGGA CCTCTGGTTG TCTTCACTGC
179461 TCATTATATG TTAATTATAA TGTATTAACA TGCTAAAAGA CACTCCTACC AGCATCATGA
179521 CAGCTTACAA ATACTGCGGC AATATCTGGA CTTTACCTTA TATGGTCTAA AAGGTGGAGG
179581 AACCCTCAAT TTTGGGAATT GTCCACCCCT TTTTTGGAAT GCTCATGAAT AATCCACCCC
179641 TTGTTTAGCA CATAATCCAG AAATAACTAT AAGTATGCTT ATTTGAGCAG ACCACGCTGC
179701 TGTTCTGCCT ACAGAGTAGC CATTCTTTTA TTTCCTTACT TTCTTAATAA ACCTGCTTTC
179761 ACTTTACTGT ATGGACTTGC CCTAAATTCT TTCTTGTGTG AGATCCAAGA ACCCTCTCTT
179821 GGGGTCTGGA TCAAGACCCC TTTCTGGTAA CATCTTTCTG GTGACCACGA AGGGACAATA
179881 CTGAGGAGAC TCTGAAGCCA AAGGAAACAG ACTACAGCAC CAACTGGCTG ACTTTGGGTA
179941 AGTGGTGGAG TCCCCGGGTA AAGGATAGGA TTGGGTTAGA GGTGCAACTT AGGGGAGATA
180001 GGGTCTCTCC TAAGACAGAG AGGGTTTCAG TCCGCTCTTA ATAAAGGGCA AGAATGCTTG
180061 ACCGAACTTG GGTTTGAGAC CCAACTTAGG AAGGCTACAG TCCTTAAGAT TTAAGGGGTT
180121 AGAGGCCCCT CTCAGTAAAG TCTCTCTTGG TTAAAAACGG ATTTAGCATT AGGGGATGTT
180181 AACTGCTATT CTGTTTGTAT TAATCTTCCC TGTGCTCTTT GCTGACAGCT ATGGGTGACA
180241 GGATTAGGCA TGTACAGGAT CACGGGACAT TGGGAACTTT TCTTCTCTCC AAAAGGGGAA
180301 GCTTGACAGC TGATAGGACT GTTGGAAAAG ATCCCTTTGC TATGACAAGC AGCCGCCTGA
180361 ACTTTTGATT CAGTGTTGCT GCAATGGGTG GGTCTTTCTC TGGCCTCTGT GAACTCCTCA
180421 CCTTCCCCAT CTCACCACAG GCAATGCTTT TCTCCCTTTC TCTCTTTTCT CTTTTCTGTC
180481 TTTTCTGTTA CTTGAGACAA CCATCTTGCC CAGAGACCAT ATGTTGAAAC TCCTGGTCAG
180541 AAGTTTGATT AAAGATGAAA GGGCCTATCT GGGGGCAAGT TTGAGCCTTC CCAGTTAGAT
180601 ATTGGGTGCT AAGTGGAGTG GCCAATGTCT ATGTTTTGTC ACATGTATAT TGCTCTGGCT
180661 GAAATGGAAA ACGTTAATTT GGTTACTTTA TGTGGCCATT GGGCAGCATC TTACAAAAGT
180721 GAGAGACATT TATTTGCCTG TGGTTCCATG AAACAGAAAA AAGTTGGTTT TCTTTTGTGT
180781 CGTAGCTTGG ACCCAAGGGC TTTGCAGTGA GCAAGGTTGC TAGTGCTGCT CAGTGAAAGA
180841 GAACCCAGAA ACCTGGCATG CCAGCAAAAG GGTAAGATT TCTTACCAGT CAGGCTTCTG
180901 GCCTCTCTCT CTTAGTGAAA ACTGAATGAA TGGTAAAAAT CACTGTTTAT CACCTCTGTA
180961 AAGTTTTGAT TAATGGGAAC AAGGATTTGT GGGGCTAGTC TTAAGCTGTA ATGAATCTGG
181021 TATACTTTGT GATATCAATT TGTCTTTCTG TATTACTCTG TCATAAAGAG GAATATGGTA
181081 GGATAGAACA TGGGCTCAGG ACTCCATAAG CCTGCTGTTC AAGCCAGCCC AGTAAACTGG
181141 TCCGTTGCAA AGTTTATTAC AGGTCCCTGG AAAAAAAAAA AAATAAAAAC TGGATGAAGT
181201 TTCCTTCTCA TCTTGTTTTA TGTCCTTTGG AGCTTCACCT TGTAACCACG TGGCGGTACT
181261 TTCTCTTGGT CTCTGCCATC CAGGGAACAG GAATTTTGGG GTTTATGTAA TAGTTAACTC
```

Figure 1 (Page 56 of 73)

```
181321  TAAAAATTAT  CTCAAGCCAT  TGCAAGCTCA  AAATTGGCTG  CTCTGGACCC  CTTCTGGGAA
181381  GGGCAATGGA  AACTAACCAG  TGTTGTAGCT  CAGCAGCTAA  GGATTTGTCA  TTTTATAATG
181441  GCGGCCAAGG  TTCAATCCTG  GCTTAGGGAA  TGAGTACTTT  CTGATTGATA  TCTGTGTGAC
181501  CTTTACCATT  TGTTGATTCT  GTTCTCTTCC  CCTCCACACA  CTGTCTTGAG  TTTTCCTCTC
181561  TCTGAGAACC  TGGGAGATTA  TCTTTGGTAA  AGTTCAAAAG  CCAGAAATAA  TGGCCGTGTG
181621  GGATGGCTAA  AGTTGAGTAA  TAAGAAACTT  AAAAGGACTC  CTTTTTTTTT  TGCTTTAGAG
181681  TGCTATGGTT  TATGGTTAAA  AGCTTAATTA  AAAGTGGATA  TTCAATCTCT  AAAAGCCTGG
181741  GACTCCTTGG  GAAAAGCAGA  GGAGGCACCA  CAGACCCCAT  TTTGGGAAAA  CCTCTGTTTT
181801  CCTCATGAAA  CCCCAGGAAC  TGGAAGTGGA  TAGATCCTTC  GCAAAATCTA  AGGCTCTGTT
181861  TGGCTTTGCA  TTATGTTATC  TGATGTTTTT  GACTTTGGG   GGTATCAGAA  ATTACTTTGC
181921  ATTATGAGGG  AGATCTGGTG  TGTAATAACC  AGGTAGGAAA  TATACTTCTG  GGGATAGCTA
181981  AAGGCAAATA  TAGGTGAATA  CTTGGCTATT  TGCACTTTTG  GATCACAAGA  AGCATTCTCT
182041  TGACTACCTA  GAAGGTATGG  AAATGTCTCC  ATCCCCACCG  AGAGATAAGA  TTCCCAGGGG
182101  AGATGGCTGA  TCCCCCAAAA  GAGGGCTGAT  TCCCTCTTTT  GGGATCCAGG  ATCTGGTATA
182161  AAAATGGGAC  CCTGGCCAGG  CACAGTGGCT  CACGCCTGTA  ATCTCAACAC  TTTGGGAAGC
182221  CTCAGAGTTA  TGAATGTCTC  ACCATACTGA  CACTTTGTGA  CTGAGCTCCT  CTCTACCCTG
182281  GACACAAGAG  ACCCTAATAA  TTAGACAGGA  ATATCATTGC  CCCTATTTAG  TCTGAAGAAG
182341  TTATAGAAGA  CGGATCTTTA  TCCCACTGCA  ATCCTTAGGA  TTAAGGGTTC  CCTGGTAAAA
182401  GGGAGTGGGA  AAATATGTCA  GAGGCATTTG  AATCAGAGTG  ACTCCATCTT  GAATAGGGGC
182461  TGGGTAAAAT  AAGGCTGAGG  CCTGCTGGGT  TAGGTTAGGC  ATTCTAACCA  GGAGTTTAGT
182521  CACAGGATGA  GATAGAAGGT  TGCACAAGGT  ACCCGTCACA  AAGACCTTGC  TGATAAAATA
182581  GGTAACGGTA  AAGAAGCCAG  CTAAAGCCCA  CCAAAACCAA  CATGGCCACA  AAAGTGACCT
182641  CTTGTCATCC  TCACTGCTCA  TATACACTAA  TTATACTGCA  TTAGCATGCT  ACAAGACACT
182701  CCCACCAGTG  CCACGACAGT  TTACAAATAC  CATGACAACA  TCTGGACGTT  ACCTTATATG
182761  GTCTAAAACG  GGGAAGAACC  CTTAGTTCTG  GGAATTGTCC  ACCTCTTTCC  TGAAAAATTC
182821  TTGAATAATC  CATTAGTTTA  GCACATAATC  CAGAAATAAC  TATACGTCTG  CTTATTGAG
182881  CAGTCCATAC  TGCTGCTCTG  CCTATGGAGT  AGCCATTCTT  TTCTTTTATT  TTTATTTTTT
182941  AGATAAAGAC  TCGCTCTGTC  ACTCAGGCTG  GAGTCTGGAG  TGCAGTGACG  TGTTTTGGCT
183001  CACTGCAACC  TTCACCTCCC  GGGTTCAAGC  AATTCTCCTG  CCTCAGCCTC  CCAACTAGCT
183061  GGGACCACAG  GTGGGTGCCA  CCATGCCTGG  CTAATTTTTG  TATTATTAGT  AGAGATGGGG
183121  TTTCGCCATG  TTGGCCAGGC  TGGTCTCGAA  CTCCTGGCCT  CAAGCGATCC  ACTTGCCTTG
183181  GCCTCCCAAA  GTGCTAGGAT  TACAGGCATT  ACCCACTATG  CATGACCCAT  TCTTTTATTT
183241  CTTAACTTTT  TTTTGTTTTT  TTGAGACAGA  GTCTCACTCT  GTCACCCAGG  CTAGAGGCTG
183301  GAGTGCAGTG  GTGCGATCTT  GGTTCACTGC  AACCTCTGCC  TCCTGGGTTC  AAGCGATTCT
183361  TCTGCCTCAG  TCTCCTGAGG  AGCTGGGACT  ACAGACATGT  GCCACTACAC  CCAGCTAATT
183421  TTGTATTTTT  AGTAGAGACA  GTGTCTTGCC  ATGTTTGTCA  GGCTTGTCTC  GAACTCCTAA
183481  CCTCAAGTGG  TCTGCCTGCC  TCAGCCTCCC  AAAGTGCTGT  GATTACAGGC  ATAAATCACT
183541  GCGCTCGGCC  CTTCTTTACT  TTCTTAATAA  ACTTGTTTTC  ACTTTACTGT  ATGGACTAGC
183601  CCCAAATTCC  TTCTTGTGTG  AGATCCAATA  ACCCTTTTGT  GTGTGAAAGA  ATGTATTGCT
183661  GCTGTTCAGG  CTGGAGCAAG  CTGGAGCTCA  TGCTGCTGCT  CAGACTGGAG  CATGCGTGAT
183721  CTGTGATCCC  AGTAAGAGGA  TCATGGTCAC  TCCAGCCTGA  ACGACAGCAT  GATATCTCAT
183781  CTGTAAGAAA  AAAAAATTAC  TAGAGGGCTT  TAACAGCAAA  TTTGAGCAGC  AAAAAGAAGT
183841  AATCAGTGAA  CTCAAAGATA  GGTCAATTGA  AATGATCTAC  TCTGAAAAAC  AGAAAGAAGA
183901  CAGAATGAAG  AAAAAGAAAT  AGAGCCTTAG  AGACAGGGGA  TACCATCAAG  CATACTAATA
183961  TATGCATAAT  GGGACTCCTA  GAAGGAGAAA  AGTGAGAGGA  CAGGGAGAGA  GAATGTTTGG
184021  AGAAATAATT  TCTCAAAGCT  TCCCATGTTT  GGCAAAAAAG  CATTAACTTG  CATACATATT
184081  TTAGGAGCTC  AATGAATTCC  AAGTAGGATA  CACTCAAAGA  GATCCATACC  TAGACACATC
184141  ATAATCAGAT  TATCAAAAGA  TGAAGAAGAT  GAATCTTGAG  AGCAGAAAGA  AAGGAACAAT
184201  TCATCACATA  CAAATAGTAC  TCAAAAGATG  TCTGGAGTAG  GTATACTAAT  ATCAGACAAA
184261  ATAAACTTTA  AGATAAGCAT  TGTTATAATA  AATAAAGAAA  GGTATTTTGT  AATGATAAAA
184321  GTGTCAATTC  ATCAAGAAAA  CATAACATTA  TAAACATACA  TGCACCTAAC  AACAGAGCCC
184381  TAATATTCAT  GAAACAAAAC  TGACAGAATT  GAAGGGAGAA  ATAGAAAATT  CGACAATAAT
184441  AGTTGGAGAC  ATCAATACCT  CACTAGTTAG  ACAAGATCAA  CAAAAAAATA  GAAGACTTAA
184501  CACTTGAAAA  CACCTAACCT  GACCCTAACA  TAAATCTATA  GGTCACTACA  CCCCAAAACA
```

Figure 1 (Page 57 of 73)

```
184561 GCAGAATAAA CATCCTTCTG AAGCTCACAT GAAACATTTT TCAGGATAGA CTGTATATTA
184621 CTTCATGAAA TAAGTCTCAA TAAATGTAAA AGGACTATAA TAATAGAGTA TATATTCTCT
184681 GACCAAAGTG GAATGAAGAT AGAAATCAAT AACTAGGCTG GGCGTGATGG CTCACGCCTG
184741 TAATCCCAGC ACTTTGGGAG GCCAAGGCGG ACAGATCACG AGGTCAGGAG TTTGAGACCA
184801 GCCTGACCAA CATGGTGAAA CCCTGTCTCT ACTAACAAAA TACAAAAATT AGCCAGGCCT
184861 GGTGGCATCT GCCTGTAGTC CCAGCTACTC GGGACACTGA GGCAGGAGAA TCACTTGAAC
184921 CCAGGAGGCA GAGATTGCAG TGAGCTGAGA TCGCGCCACT GCATTCCAGC CTGGGAGACA
184981 GAGCGAGACT CCGTCTCAAA ATTAAAAAAA AAAAAGAAAC TAGAAAAATA AGAACAAATC
185041 AAACCCAAAG CAAGCAAGAG GAAAATGAAA AATTTCAAAG CAGCCAAGAA CAAAAGGCAC
185101 ATTATGTACA GAAGAACAAG TGTATAGATC ACATATTTCT CATAGACACA ATATAAGCAA
185161 AAAGACAGTG GAGCAAAATT TTTTAGATTA ATGAAAGACC TACAATTCTG TACCAAGCAA
185221 AAAAACTCCC CCCAAATGAG GGTGAAATAA GACAATTTAA TACAGAGAAA AGAGGAAGGA
185281 ATTTATCTAG TCATATGTGA GAGTTTTATG ATACATTTTG TACTGTATAT GTGGATGTTT
185341 TCTATTTCAT TTAAAAAATC AACCGTGCAA TTAAATGGTA GATTGTCTTG CTTCTTTTTG
185401 ATTGACACAG TCATTAACTA AAATATTGTA GTATTTTTTT ATCTCCCTGC CTAAAGGCAA
185461 TAAACATCTA ATCAGCAGAC TAGAACAATA AAAAATATTT TTTAAAAGTC CTTTAGGCAG
185521 AATGATAAAA GTCCCTTAGG CATATTGAAA TTCCTATTTA TACAAAGGAA TAAACAGTAC
185581 TAGAAATTGT AACTATGTGA GTAAACAGAT AATATTTTTT CTCCATAAAA TGTGGTTGAC
185641 TATTTTCACA AAAATAGTTA ACAATGTAAT GTGTGATTTA TAGCATTTAA AAGTAAAACA
185701 GGCCGGGCAC AAAGGTTCGT GCCTGTAATC CCAGCACTTT GGAGGCCGA GGCGTGCAGA
185761 TCACTTGAGG ACAGGAGTTC AAGACCAGCC TGGCTAACAT GGCAAACCC CATCTCTACT
185821 AAAAATACAA AAATTAACCA GGCGTGGTGG TGCACGCCTG TAATCCCAGC TACTCTGGAG
185881 GCTGAGGCAC AAGAATCACT TGAATCCAGG AGGTGGAAGT TGCAGTGAGG CAAAATTATA
185941 CCACTGTGCT CCAGCCTAGG CAACAGAGCT AGACTCTGTC ACACACACAC ACACACACAA
186001 AAGAAAAGTG TATGACAACA ACAGTGCAAA AGAAGTGGAA ATGAAAATAA TGTTATTTTA
186061 TATAAGTGGT ATACTTTTAG ATGAACTACG ATAAATTAAT GATGTATACT ATAAACTCTA
186121 AGGCAACCAC TGAAATAATG AAACGAAGAA TTATGGCTAA CAAGCCACAA AAAGAAATAA
186181 AATAGAATGA GAAAAAATAT TTAAGTTGTT CAACAGATGG GAAAAAAAAG AGGAAAAAGA
186241 GAACAAAGAA CAGATGGGAC AAATGGGAAA GTAATAGCAA GATGATAGAC TTAACTCTAC
186301 CCATATAGAT TATCACACTT AAGGTAAATG ATCTAAATAC TCTAATACAA AAGCAGAGGT
186361 TGTCAGATTG AATTAAAAAA ACAGACAACA ACAAAAAAAA GCAAAAAAAG AGCCACAACA
186421 TGCTGCCTAC AAAAAATTCA CTTTAATATA AAGACACAAA TAGTCTAGAA CACCATCACT
186481 TTTAACCTTA TTTACTCAAA CCTCCTGATC CCTATTTATT TATTTATTTA TTTATTTATT
186541 TATTTATTTA TTTATTTATT TTGAGACAG AGTCTGACTC TGTTGCCCAG GCTGGAGTGC
186601 AGTGGCACCA TCTAGGCTCA CTGCAGCCTC TACCTCTCGG GTTCAAGCGA TTCTCCTGCC
186661 TCAGGCCTCC CAAGTAGCTG GGACTATAGG CACATGCCAC CATGCCCAGC TAATTATTAT
186721 ATTTTTAGTA GAGACGGGGT TTTGCCATGT TGGCCAGGTT GGTCTCAAAC GCCTGACCTC
186781 AGCCTCCCAA AGTGCTGGGA TTACAGGCGT GAGCCACAGC ACCCAGCTCC TCTTCATTTA
186841 TTCTTGCTAC GCTTCCTCCA ATCCATTTTG TGCATTTGAT GATTTTGCCA GTAACTTCTT
186901 TATTTTTCTG GTAAAATTAC TTATGGGTCA CTGAGGACTG GATGTTCTT TCTTCTAGAG
186961 GGGGTTTGTG TCTGCTTTTG CCAGGAAGCT GGGGTACCAC CAGTCAAGTA TTACTTTAAA
187021 CTCAATTCAT GAATTGAGAC TTTTTTTTTT TTTTTTTTTT TTACGCAGAG TCCTACTCTG
187081 TCACCCAGGC TGGAGTGCAG CGGTGTGAAC ATGGCTCACT GCAGCCTCAA CCTACTGAGC
187141 TCAAGCAATC CTTCTGCCTC ACCATTCTGT ATAGCTAGGA CTACAGGTGT GTGCCACCAT
187201 GCCTGACTAA TTTTTTAAAT ATTTTTTTA GAGATGGGGC TCACTTTGTT GCCCAGGCCA
187261 GTCTCGAGCT CCTGGGCTCA AGTGATCCTC CCACCTTGGT CTCCCAAAGT GCTGGGGTTA
187321 CAGGCATGAG CCTCTGTGGC TAGCCAAGAC TTTTTATTTT TTAGCCTAAA TGTGTATAAA
187381 AGTTGGCTTG TGGTTACAAC TTATCAGGAT TGATGATCTC TCTCTCTCTC TCTCTCTCTC
187441 TCTGTCTCTC CCCACCTCTC TCACATCCCT TGCTCTGCTG AGAAGCAGAG CAAACATTCT
187501 AGCAGTTTCC AGAGAGTAGG ATGGGATTAC TTCTAGTTTA CTTTTATCAT CCTTTGGGAT
187561 CGCAGTATTA CTGGGAGAAC ACAAGTATCT CTTATTAGAC ATACCACCTT TGTAGAATCT
187621 GGACTTTCAT TTTAGACTTT ATTTGTTTTC TACTATAAGC AATTTAAGTT ACAGATCTCT
187681 CTACACACTG TTTAAGTTGC ATCCCATGAA TTTTGATGTG CTTTATTGTC ATTATTATAT
187741 AGTACAATGT ATTTTGTAAT TTTTGTGAT TTGTTTGGAG AGATTGATTA ATTAGAATGA
```

```
187801  TGTTTAATTT  CCAAATATGT  GTGTTTTTTT  CTACATTTCT  TATTTTTATT  GATTTCAAAT
187861  TTATTTCTAC  TGTAGTCAGA  TTTAATAATT  CATTTATTTT  TATTATTTTC  ATTTTTTTAG
187921  AGACAGGGCC  TTTCTGTGTT  GCCCAGGTTT  GTCCCAAACT  CCTAGTCCCA  AGCAGTTCTC
187981  CTGCCTCAGC  CACCCAAAGT  GCTGGGATTA  TAGGCACGAG  CCACCCGTGC  ACAACCAACA
188041  ATTCATTTAA  AAAGTGGGCA  AGTGAACTGA  ACAGACATTT  CTCAAAAGAA  GGCATACAAT
188101  TGGCCAACAA  ATATATGAAA  GAATGCTCAA  CATCACTGTA  TTAGTCTGTT  TTCATGCTGC
188161  TAATAAAGAC  TTAACCTGAG  ACTGGGGAAT  TTACAAGAGA  AAGAGGTTTA  ATGGACTTAC
188221  AGTTCCACAT  GGCTGGAGAG  ATCTCACAAT  CATGGTGGAA  GGCAAGGAGG  AGCAAGTCAC
188281  ATCTTACATG  GATGGCAGCA  GGCAAAGAGA  GAGCTTGTGC  AGGGAAACTC  CCGTTTTTAA
188341  AACCATCAGA  TCTCGTGAGA  CTCATTCACT  ATCATAAGAA  CAGCATAGGA  AAGACCCGGC
188401  CCATAATTCA  GTCACCTCCC  ACTGGGTTCC  TCCCAGGACA  CATGGGAATT  GTGGGAGTTA
188461  CAATTCAAGA  TGAGATTTGG  GTAGGGACAC  AGCCAAACCA  TATAAATAAC  TAATCATCAG
188521  GGAAATGCAA  ATCAAAACCA  CAATAAGGTA  TCATCTCACC  CCAGTTAGAA  TGGCTATTGT
188581  CAAAAAAACA  AAAAATAACA  AATGCTGGTG  AGGATGTACA  GAAGAGGGGA  CTCTTATGTC
188641  CCACTGGTGG  AAATGTCAAT  TAGCATAGCC  ATTATGCAAA  ATAGTATGGA  AGTGAGGTAG
188701  GTTACATAGG  GTGGTCACAG  CCTCCCTTGA  AAGGAAACAA  GAAACTTGTC  AAATTGATGG
188761  AGAGAACAAA  TCTCTTGACA  TTACACAAAC  TGCATCTGGG  GCTAGTGGTT  AGAATATCCT
188821  CAGTCAAGGA  GGTAGAAGAG  CAGGAGGGAA  AATCCCTAAG  TTCGTGCAAG  TGCAGAAACC
188881  CACAAGCTGT  GTTCTCAGGT  TGACATATAC  TCATTTTAAT  AGTAAGAAAC  ACACCCTTGG
188941  GTAGAGAATT  AAAATGCTAA  TAATACATGT  GATGTATGTA  CTAGCGTGTA  TGGCAATATT
189001  GCATGCACAT  TCAAGAGACC  ACCCAAAACA  TATTTAACAA  CAATGCCCAT  TCCCACCCCC
189061  TCATGGATAA  TCACGTAGGA  CTCCCATAAC  GGGAGTTTCT  TCAGTGTCAA  TTGGTGCTGA
189121  AGTAGCCGAC  CCTGACTCTG  CTATCAGCGT  GTACTTTCAC  CTTGCAATAA  ACTCCTTTGC
189181  CTACTTTTAC  TTTGGACTGG  CTTTCAAATT  CTTTTGTGCA  GGGAATTCAA  GAATCTGAAC
189241  CAGCCTACTG  ACAACAGAGG  TTTCTCAGAA  ACCTAAAAAT  AGATCTACCA  GATGAGGCTG
189301  AAAATCTGCT  ACTGGCTATT  TATCCAAAGG  GAAGGAAATC  AGTATACAAA  GAGACACCTA
189361  CATCCCCATG  TTTATTGCGT  CACTCTTCAC  AAGAGCTGAT  ATATAGAGTC  AACCCTAAAT
189421  GTTCATTAAC  AGACAAATGG  ATAGAAAATG  TGGCATATAT  ACACAATGAA  ATACTATTTG
189481  GCCATGAGAA  GAATGCAATC  TTGTCATTTG  TGGCAACGTA  GATGAAACTG  GAGAACATTA
189541  TGTTAAGTAA  GATAAGCTAG  GATTGGAAAG  ATAAATACTA  CATGTTATCA  CTCATATGTG
189601  AAAGTAGAGA  AAAATTTTTA  GCTCATGGAT  TTAGAGAACA  GAACTGTGGG  TACCGGAAGC
189661  TGGGAAGGGT  AGCAAGGAGG  GGAGGATAGG  GAGAGGTTGG  TTAATGGTGA  CAAAATTACA
189721  GCTAGATTGT  AGAAATGAGT  TCCGGTGTTC  TGCACCATTG  TAGGGTGCAT  ATGGTTAACT
189781  CTCATTTATT  GTATATTTTC  AAAAAGCTAG  AAAAGAATTT  TGAATACTCA  CAACAAAATA
189841  AATGATAAAT  GTTTAAGGTG  ATGGATATAC  TAATTACTCT  GATTTGATTA  TTACACATTG
189901  TGTACACATA  TAAAAATATC  ACTCTTTATC  CCGTATATAT  GTACAGTTAT  TATATGTCAA
189961  CTAAAAATAA  AAGAAAAAAA  GAATATGATC  TATCATGATG  TATATATCAT  GTGTACTTGA
190021  GCAAATGTG   CATGCAGATA  TTGTGTATAA  TGTTCTATAA  ATCAATTAGC  TCAAGATAAT
190081  AGATAGGATT  GTTCAGATCT  TCTGTGTCTT  TACTGATATT  TTGTCTAGTT  ATTGCATCAT
190141  TACCAAAAAA  AGGGTGTTAA  ACTCTCCAAA  TGTGATTGTA  GAATTGTCTA  TTTTGTCTTT
190201  TCTTTTCCAT  TTTTACTTTA  TGTATTTTGA  AACTCTGTTA  TGACATTTTG  CTATGTATTT
190261  TAAAACTTCG  TTATGTATTT  TGAAACTCTG  TTGTTAGAAT  CATACATTTA  TGATTATTAT
190321  GTTTTCTTGA  TGAAATGACA  CTTTTCTATT  GTCATTGTTT  TTGTTTTTTC  TGAAATGGAG
190381  TCTCACTCTG  TTGCCCAGGC  TGGAGTACAG  TGGCACAATC  TTGGTTCACT  GCAACCTCCA
190441  CCTCCTGGGT  TCAAGCGAGT  CTCCTGACTC  AGCCTCCAAG  TAGCTGGGAT  TACAGGCATG
190501  TGCCAGCATG  CCAAACTAAT  TTTGTATTTT  TATTAGAGAC  AGAGTTTCAC  CACGTTGGCC
190561  AGGCTGGTCT  CGAACCTCTG  ACCTCAGGTG  ATCCGCCCAC  CTCGGCATTT  TTATTTTATT
190621  TTATTTTTTT  GAGACAGAGT  CTCACTCTGT  CACCCAGGGT  AGAATGCGGT  GGTGTGATCT
190681  TGGCTCACTG  CAACCTCCGC  CTCCTGGGTT  CAAGCAATTC  CCATGCCTCA  GCCTCCCGAG
190741  TAGCTGGGAT  TACAGGCACA  TACCACCATG  ACTGGCTAAT  TTTTGTATTT  TTAGTAGAGA
190801  TGGGGTTTTT  CTATGTTGGC  CAGGCTGGCA  ACTGACTCCT  TTAACAATAC  AAAAATATCAC
190861  TCTGTCTCTG  GTAACACTCT  CTGTCTTAAA  CTCTATTTTA  GCTGTTATTA  TTATAGCCAT
190921  TTTAGTCTTT  TTATGCTTTC  TGTTTGCATA  GTGTATATAT  TTAATATGT   TTATTCTCAA
190981  GTTATCTGTG  TTTTTATATT  TAAGATGTTT  CTCTTCTAGC  CAACGTGTTT  GGTTCTTGCA
```

```
191041  TTTTTAAGTC GATTCTAACA ATCTTTGCCT TTCAATTGAA ATATTTACAC CATTAACATC
191101  TAACATTAAC ATTTATTTTT CTTTCCACAG TACACTGGCT AGCATCTCCC ATATAATATT
191161  GAACATAAAG TGTGATAACT GACATCCTTA TTTCATTCCT ACTCTGAGTG GAAAGGGCAG
191221  GGGTGGAGAA AGCATTCAAC AATTTGCCAT AATTATAATG CTTTTTGTTA CACTGTTTTC
191281  TTCTGCATTA AAAAATATCA TTACATTTTG CATGAATTAT TAGGAGAAAA TATTTTCCAA
191341  TTTTCCTGGA AAATGCCATA ACCACGTCTC TCAATTTTGT TTCCATCTTT CTTCCACATT
191401  TTACATAACC TACATAAGAG ACACATTATC AAGTATATTT TACATGGCTT CTCAGTGTCT
191461  TCTCTGTCTG CTAACAGGTT TACCAAGAGA TGGCACTCTT GTATTTCTGG TGGCTATGTC
191521  CATATCGTTT TGCCTTTAAG ACAGCGTAAC TACTTCTTTC ACCAGTATTA AAGACATGTA
191581  CATTTGATCT GGTTCTTGTG GATGATTTTA AATGACTCAA GCTAATAATC CTAATTTTAC
191641  CTAAACACTC CATTATTTTA AAATGTATTC CTTTATGCCC ACAATAAACA TTTATTGACA
191701  TTAGGCTGGA CATTAGGCTT CTCTATGGCA GACATTAGGC TGGACCCTAG CCATATATCT
191761  ATTGAGGGAA AAAAAATTAT TTTCTATATA AGTTTCCAGA AAGCCAAGAT GTGTTTTAAA
191821  AACAAAACAA AACATTACAT TCTAAATGCT GTAACAAGAT AAGAAAAAGT GTTGAGGCTG
191881  AGAGAAGAAC AAAGCAGCAA GCAACTCCTG GAAGGACCAC TGCTGCAGAG GTAATAACTG
191941  GTGAACCATG TTTTGGAGAA GGAAAAGGTC ACCAAGAGAA GGAGGGGGTC CAGGGTGTTC
192001  AGAAAGATTG CATGCATAAA GATCAAGGGT AATAAAAAAA ATTCCGTATT ATGTAAATGT
192061  GAAGTTCCAG GACCATGAGC TTGGAGAGCA TGAAGTACAG GAGGAGGGTT GGTTTCAAAT
192121  AAATCTGGGA ATGAAACAGT GAAGCCTCTG GCAGAACTCA CATCTCTTTC CTCCCCTCTT
192181  CCTTGCACAT TCCCTTTATG GAGTAATTGC AGGGATGGGA AAAGTTCAAA ACCACCACTG
192241  AGCCTAGGAA GTGCTAGGGT AAAGTGGAGA ATGAACCTGC GTGATTTGCT CATCCTAAAC
192301  TAGGTTCTTC TAGGAGAGCC CTTCCCCATA AAATCTGCCC TCCTCGAAGG GGCCCAGACA
192361  GCCTAAGCTC ACCTCCCAAA GACCCCTTAC TTGCTGACTG AATCTGATTC CACCCAGACA
192421  TGGCCTAAAA CCCTTCCATA ACTCTATAGC CAAATTCAAT TTTAGACAGG CCTCATACCA
192481  ACCTTTCTTC CTCTAAGTCT GCCACCCTAG GCAATTCTCA ACATTCTCTA CACACTTTGG
192541  GGCCATAGAC GTGCTACCAA GTCTCCAGAC CTAGACCTGA TGGAGCAGTG CTGTAATGAG
192601  ACGACCACTG GCCTTTGAAC CAGACCCTTC TCTGTGGCTC CTATGCATCT CCAACCTGTT
192661  TTGAGCACTG CTGCCAAGAC ATCTTTGGCA CTTTGTTGTG AAGTTTTAAA ACTGAACTAA
192721  TCTACAAAAC ACCTAACCTT TAAAAATTCA TTGTCATTTC ATATCATGAA AGATAAAGAA
192781  AGGCCAGGAA ACTGTTCCAG GTTAATAGAG ACTAAAGAGA TAGCAACCAA ATGCAATTTG
192841  TGATCCTGGA TTGAGGGGAA AAAGTGTTGT CAGAGACATG ATTGGGACAG CTGGTAAAAT
192901  TTGAATTTGA ATTTAAAGAT AAAGTATTGA GTAATATAGG AAGATGATTA TCTGCAACTT
192961  TCAAATGTTT CAGTAAGTAT ATATATATAT AAAGAGATAT AAAGACATAT AAATAAATGG
193021  ATAGGTAGAG AAAAAGCAAA TGTATAATAT TAACAATCTA GGTAAAAAGT ATATGAGTGT
193081  TCTTTGTACT GTTTTTCTGA TTTTTCTATA TGTTTGAAAT CATTTAAAA TAAGAAGGTT
193141  TTTGGGTTTT TTTTGTTTGT TTTTTGTTTT TAGAGACAGC ATCTTATTCT GTCACCAGGC
193201  TGTAGCTCAG TGGCCCAATC ATTGCTCACT GCAGCCTCAA CTTCCTGGGC TCCAGTAATT
193261  CCCCCTACCT CAGGCTCATG AGTAGCTGGT ACTTCAGGTG TGCACCACTG CACTCAGCTA
193321  ATTTTTATTT TTTAAATTTT TGTAGAGATG GCATGTTGCT ATGTCACCCA GGCTAGTCTC
193381  AAACTCCTGC CCCCAAGTGA TCCTCCCACT TTGGCCTCCC AAAGTGCTAG AATTATAGGC
193441  ATGAGCCACT GCACCCAGCC CCAAATAAAA AAGTATTTTA TTTTAATTAA CTAATTAACT
193501  TTGAGTCAGA GTTTCACCCT TGTCACCCAG GCTGGAGTGC AATGGCATGA TGTTGGCTCA
193561  CTGCAAACTC TGCCTCCTGT GTTAAGCGA TTCTCTTGCC TCAGACTCCT GAGTAGCTGA
193621  GATTACAGGT GCCTGCCACC ATGCCAGCT AATTTTTATA TTTTTAGTAG AGACGGGGTT
193681  TCAGCATGTT GGTCAAGCTT GTCTCAAACT CCTGACCTCA GGTGATCCAC CCACCTCCGC
193741  CTCCGAAAGT GTTGATGAGC CACCACACCC GGTCTAAAAA GTATTTAAA ACCACAGTCC
193801  CACTCTACCT TGTCCTACAC TACCAGGGGC TAGGATCACC CCATGTCTTC TAGGCTATGA
193861  GATAGAGGAA TCCAAGGAAG AAGATAAGCT ACTTGGTTCC TCTATAGGGT CTTGTGTGTG
193921  CTCTCATGTG CTCTCTCTCT CTCTCTCTCT CTCACACACA CACACACACA CACACACACA
193981  CACATGAATA CCAGAGCTAT CACTTTCCCA GTCTAGTACT CATCTCATCC CAAGGGTTTT
194041  GTGTTGTAGT GGTTTGCTCA TTTCTTTGTT TTGTTTGTTT GCTTGGATTA TTCTTTTTCT
194101  CTTTTTGCAG CTGAAGGGAG AATTTCCAGG CCAGCCCTTT GGCCATTAGA GTTACAGTGC
194161  CTCTATTCAG GCTTCATAGA GAGACCTGGG ATTCAGTAGT GGGGGCTTT TATCCAGTTC
194221  AAAATAATGC ATTCTCACCA AGATGTACTT TGAAATAAAA CAATACTAAA ACACAAAATT
```

```
194281 TTATTTATGC TGAACATTGA ATCACTTTTT TCTGTATTTT GTGTAGAAAG TTATACACAC
194341 ACAAACACAT TGCTCCTGC  TTTGTTTATT GGCCCAGGGG TATGTTTGGT AATACTTCAT
194401 CAGGCATGAG TAGTACGTCT TGGAAGGTGT GGTCTAAAGC CTAGACTCCT ATCTGCTTCC
194461 TTCAGCATTC TCCAGTGTAT CTGTCATCTG TCTACCTTAG GATAGGGTC  TCCAGAACTT
194521 CCATTCACAT TTAGAAGAGG GCAGCGGCTT TCTATGGAAA ATATGAACTC TCATTCATCT
194581 CTATTCCTTC TTCTAGCTAT GGTCCAGCTC AGCTGTTTGG AATAAAGTAT CTATATGAAG
194641 TCTGCGAATG GTTCTCAGAC TGGTTGAACA TTAGAATCAC CTGAGTACCT TCTAAAATTC
194701 TTATTACCCA GGGCATATCT CAGAATGAGT ACCGCAGGGT AGGGATAGGA TTAGGGATCA
194761 TGATCTCTGG AGTCTGGTTT AGGCACTAGT GCTGTTTAAA ACTACGTTCA TGAGGTGGAG
194821 GTTGCAGTGA GCCGAGATGG CGCCACTGCA CTCCAACCTG GGCGACAGAG TGAGAGTCTG
194881 TCTCAACAAA ACAAAACAAA AAAAACCAAC TACCCTTGTG ATTTGAATGT CCATCCAAAA
194941 TTGAGAACCA TTAGGTAAGG CCAAGCTGTA TAATTAAAGA GCAGTTTTCA TTTGTCTGGT
195001 GTGGTGGCAG CTTTTTGATA AGGGAAGTAT TGTTGCCATC CACATACCTG AGCCTCACTC
195061 CTGAGAACAC TGGTGTGTAT GTTGCTAAAA TTCCCCAGGT GATTCTGAGG TTCCTTCCTG
195121 GATAAAAACC ACTGACCCTG GGAATGTACC CACTGCCAAT CTCCTGCGTA AACCTTGGAT
195181 ACTGGGAAGC CTACAGTTGA AAATATTGGG CTTGAGATCC TGAAACAAAT CTTGTATTTC
195241 ATTAAGACTA ATATTTGGTA CAGTGCAGCA AATCAAGGGA ATTTTGGTGG CTGAGTTCTT
195301 TTAGAACTTT TGCATTGAAA TAGGTTCAAG CAGCAATAAG TTAAAACTAC AACCTCAGCT
195361 AAAGGATTAA AAGACACGTG AGCTGGGTAG GATGAGGTCT AAGGTTGGGT GTGGCGGCTC
195421 ATACCTGTAA TCCCAGCACT TTGGGAGACT GAGGTGGGTG GATCACTTGA GGTCAGGAGT
195481 TCAAACCAG  CCTGGCCAAC ATGGTGAAAA CCCATCTCTA CTAAGAATAC AAAAAAATTA
195541 GCTGGGCGAG GTGCCAGGCA CCTGTAATCC CAGCTACTGG GGAGGCTGAG GGAGGACAAT
195601 CACTTGAACT CAGGAGGCAG AGGTTGTAGT GAGCTGAGAT CGCACCACTG CACTCCAGCC
195661 TGGGTGACAG AGCAAGACTC CATTTAAAAA AAAAATAATA ATAATAACAA TAATAATAAT
195721 TCAGACATAT CCAGGCATCA AACAGATACC TGGGGCAGAT GAATAGTCTT GAGATTCAAG
195781 TCACACATGA AATTTAGGTG GAAAATGACA TTGGAGAAAT TTGAGATTAT GATGAATGGA
195841 AATTTTTCAA AGAGGAATTT CAGGCTCTGT TCTTGAGGGG ATAGATGGAC TTCCAACAGC
195901 AATAACACAG GATTAATGAG GACTTGGGAT GTTACATAAA TTAGAGATGT TAGATGGATA
195961 AAGAGATAAA AGTACTCTCT CTAAGAACAT GGGACCAGAG ATAGGCTCAC TTCTAACCAT
196021 CAGATATAAC TAGCAGACTA AACGGTCTAA AAATAAAAAT CATGCCCCAC TCCTGCTTAA
196081 GACATTTTAA TTACTCTCAG TAACTCTTCA GTTTTTCTAC TGTGTTATCT TTAACTACAG
196141 GGTTGGTCTG GGTGTGCAAC ACAAGAAAGC CTGGCATATA CATGGATTCA AGTGTATGCC
196201 ATGTGCAGGT ATTCTTTCAT GTACTATTTC ATGTATTCTT TTTCACATCT GTTTTTTCCT
196261 TCATTGAAGT CAATGGCTGA TATTAGATTC TACTATTCAT GTGTACTAGT TATATATAAT
196321 TGTTACAAAA CAAATTAGCA AAAACTTAGT GGCTTAAAGC AACACACATT TATTATTACC
196381 TAAGGTCTGT GGATAGAAGT TCTGACATGG CTTAACTGGG TTCCCTGCTT CAAGCCTCAT
196441 GTGGCTGCAA TCCAGGTGTT GGCTGAGTCT GAATTCTCAT CAGAGGCTTG ATTGTGGAAA
196501 TTTCCACTTC CAAGCTCCCT CAGGTTTGTT GAAAAATTCA GTTCTTTGCA CCGGTAGAAG
196561 CTTCTTGGTA GAGGCTGATT CAACTTCTAG AGGCTGTCTG CAGTTCCTGT CACCCAGGGT
196621 GGAGTGCAGT GGAGCAATCA TAGCTCACTG CAGCCTTGAC CTCCCAGAAT CAATCTGTTC
196681 TCCCACCTCA GCATCCTGAG TAGCTGGGAC CACAAGTGTG TGCCATCACA CCTGCCTAAA
196741 AAACAAACAA ACGAAAAAAA ACCCCAGAG  AACTTGTAG  AGACAAGCTG GTCTGGAACT
196801 CCTGCGCTCA AGCAATTCTC CTGCCTTAGC CTAAAAGTTC TGGGATTATA GGTATAAGCC
196861 ACCATACCTG GCATATGGCA AGTCTTGAGC AGGACAAATA CAGATGATTT ATGTCTGTCT
196921 TCCATGGTAT TCTAGGTTAT TGTTGAGATG GTCCTCTATT GTCTTGTTCC ATCTATTGAT
196981 TAGATAAAAC GTTGTTCCTT CTGTTATTTT TCAACAGTAG CTTTTATGTG TCTCTCTTTA
197041 TCTTAAAATT CTAACCAAAG AGCTGCTCTT TTCTTGGTGT ACTTTACCTT TGGTTGATCC
197101 TTCTTAACCT CTTCTTGCCC TCTGGGGCCT AAGATGAGGG CTGTTATCAG ATGTGAGTCT
197161 ATGGGAAAGC AAGCAAGAGG TTCTTCAGCC TCCGTTCAGC CTTAAATGTC TAGGTAGAAA
197221 TCAGTCATGG CCCTTCCAAT GTGGTACAGA CCAGATCACA GAGACAGGGG TCTCAGCCAA
197281 GGTCTTGTGG CCTAAGCCTT ATAGAAATAA TGAGTGTTTA CTTACTTGGA GAACTCCCTT
197341 GGAATATCTT TTTTTGTGAA CCTGAGGCAA CTTTTGGTGA TTTCTTGATG TCTTGGGAAT
197401 CTTGGTCTAG AGCCATTTCA ACCCGATTTC TTTTCATGTC AGTGGCATTT TGTGACCAGA
197461 TAGTAAATAA GTTCTATGAT GTTCACTCAG AGAAATACAA TGACTTATGA TGCGAAGCTT
```

Figure 1 (Page 61 of 73)

```
197521 CTGTGGTTCA GCCCTTACTT CATCTTCATT CCCTCTTATC TGCATCTGTC TCCTGCTTGG
197581 GAACAAAAGT CTGGCTTCAT TCTATGACCC CCACGTTGAG TTTCTTAGTA GCACTTACTT
197641 TTCAATTAGG AGTGTCCTCA CTTCTATCCG TCAGACATAA CTAGCCGACT AAACAGTCTA
197701 AATATAAAAA TCATGTCCTA CTCCTGCTGA AAACATTTTA ATTACTCCCC ATCATTTAAT
197761 TTTTTCTACT GGGTTATCTT TAACTTCAGA GTTGGTCTTG TGTGCAACAC AAGAAAACCT
197821 GGCATATACA TGGATTCAAG TGTATGCCAC GTGCATGTAT TCCTTCATGT ACTATTTCAT
197881 GTATTCTTTT TCACATCTGT TTTTTCCTCT AAAATTTATT TCCTTTTAAA AATGAAAATT
197941 TTGCATTTGA CTAAATTTGT CAAATTTAGT CAAATTTGTT TAAAACCATT TTTAAAATGT
198001 TTCCCGAAGT TTTGAGTGAA GTTAGTACTT CAGAAAAACT GTTTTGTATT TTTCCTGTGA
198061 CCTCAGTGCA CTGCTGTGCA TTTCCATTTC TGCGTCCACA CACATTTGTT TTGAGGAAAT
198121 ATAGGAACGA CAAGATAAAG TTCAAGCTCC TGGACATTGC ATAAAAGACC GTCATGACCT
198181 GGTCCTGTTG ACTTCCCTAG ATTTCCGCT ATTTCCTAAG TTGAGATTTT TGGTTTGGAT
198241 GCTTTGTGTT TTCCTAAAAT CAAAATAGGT TTTTGCCTTT TATGATTATA CAGTAAATAA
198301 ATGCTATTTG TGTGAAACTT TAAACAATAC AAAAAAAACC TAAGGAAGAA AGTCAGATTC
198361 ATCTAAAAAT CCTTGTGGCC AGAATTAACT ACCTTAGTTA CTATTTTCTC TATCTCTCTC
198421 TCTCAATGTA TATTTGGTGT AGGTATAGGG GTGTGTGTAG TGTGTGTGTA TGTATATATC
198481 TGTTTCTATT CCTGTATGTG GATGTGCACA ACGCATCCTG CTTTGTACAC TACAGTACTA
198541 GCATTTTTCT AATGTAATTC AATATTGTTG AAAACATTTT AAAAAAGCTT GTATATATAC
198601 ACACACATAC ACATACATGC ATGTATGTAC ATATACACAT ACAGACAAAA ATGTATCCTA
198661 TGTATATTCA CACATGTATA CACACTCACA CATACATAGA GTTTTACATC CATAGTTTAT
198721 AAATGTTGCT TTTTTTTGGT CACCTTTTTG CTAAGTCTTA CACTTTTTTT TTTTTTTTTT
198781 GAGACGGAGT TTTGTTGTCA TTGCCCAGGC TTAGTGCAGT AGCGCGATCT CACCTCACTG
198841 CAACCTCGAC CTCCCGGGTT CAAGCGGTTC TCCTGCCTTA GCCTCCTGAG TAGCTGGTAC
198901 TACAGGTGTG CGCCACCATG CCTGGCTAAT TTTTGTAGTT TTTTTATAGA GACGAGGTTT
198961 CACCATGTTG GCCAAGCTGG TCTGGAACTC CTGACCTCAA GTGATCTGCC TGCCTCAGAT
199021 TCCCAAAGTT CTGGGATTAC AGATGTGAGC CACTGCACCC GGCCAAGTCT TACACATCTT
199081 TTTTTTACCA CTAAACTGTT TACCCAAACC TGATAACCCA AGTCAACAGC TATTATGGCT
199141 CACACAATCT TATGTAAACA AAGATACAGA TATATAGAAT TTTCTTGATT AATATTCAGA
199201 AAAAAATGGA GTCCCTTTAT ACGTCCTTAG TATCTGCTTT ACTCATTTAA AAATGTATTA
199261 CATTATATGA AAGTATTCAG GTCAAATGTT ATAGATGTGA TTCATTCTTT TTAACTGTGT
199321 TATTTTTCTG CAATGACTAT GTATCACAAA GTACTCAGTC TTCCACTGAT GAAAATTTGG
199381 GCTATTTCCA GTTTGTCTTC CATTTTTCTT TCTTCCTCTT GGATTTTCAC TCAATGTGTT
199441 TACTAATTTA GGAAGAATCA ATAGTTTTTA TGGTATTACT TCTCCCATTC AAGAATATAG
199501 CATATGGTAT AGTATAGTAG AGTACTTAGT TTAATTTAGC CAGATCCTGT TTTCTGCCCT
199561 TTAATAAAAT TCTATCATTT TCTGCCTTTG AGTCACATTT TCCTTGTTCA TATAATTCTT
199621 AAAAAATGTA TAGTTTTCAT TCTAAGGGAA CATAAAAACT TCTTTCCATT TCTATTCCTG
199681 TCTAGTTAAT TCTACTATTG GGAAAAGTAA CTGTTAAAAA AAATTCTTAT CTTTCCAGTC
199741 AGTTCACCAC ATTTCCTTTA TACCTTTGTA CTTTAATCCC CAGTCATGTT GAACACTTCT
199801 TATTCCTCAC ACCAAGCCTC AACGGGTTTG CTCTTTCTGG AAGGTGCTTC CCCTGTATTA
199861 CTGACTTATT CATACCACAC ATGGAGACTG GCGCAGCCCT GTTCTGCCTG GGAAGCCTTC
199921 CCCTGATACC CCCAGTTGGC AGGAGTCTTC ATTTGTTCTT TTCTAGTCAC CTGTGCAAGT
199981 TTGTATTGTT CATGTTTATC ATCCTTCATT CTAGTTGTCT GTCTCTGTGT GTGGTCTCAT
200041 TCAGTGGACT CTGAACTCTT ATGAAGTCAT GTCATGGGTC AGATCTTAAT AAATTAATAT
200101 TGTCGGAAGC TAATGTCATG TCTAGAATAC AGAAAATTTA TCAAAAAAAA ATATAGTATG
200161 TTGGCTGGGC GCAGTGGATC AAGCCCGTAA TCCCAGCACT TTGGGAGGCC GAGGCAGGAG
200221 GATCACATGA GGTCAGAAAT TCAAGACCAG CCTGGCCAAA ATGGTGAAAC CTCATCTCTA
200281 CTAAAAATAC AAAAAGTAGC CAGGCGTGGT GGTGCCCACC TGTAATCCCA GCTACTCAGG
200341 AGGCTGAAGC GGGAGGATCA CTTGAACCTG GGAGGCAGAG ATTGCAATGA GCTGAGATCA
200401 TGCCACTGCA CTCCAGCCTG GGCGACAGTG AGACTCCATC TCAAAATAAT AATAATAATA
200461 ATAATAATAA TAATAATAAT AATTGTATGG AATTGAACTG CTCTGATTGG AAATAGCTGT
200521 TTTTTAAAAA ATTATTATTT TTAAGTTCC TGGGTACAAG TACAGGATGT GCAGGTTGT
200581 TACATAGGTA AACGTGTGCC ATGGTGATTT GCTGCACCTA TCAACCCATC ACCTAGGTAT
200641 TAAGTACAGC ATGCATTAGC TCTTTTACCT AATGTTCTCC CACACCCCA CCCCATCCTC
200701 CCCCAACAGG CCCCAGTGAG TGTTGTTCCC CTCCCTGTGT CCACATGTTC TCATTGTTCA
```

```
200761 GCTCCCACTC ATAAGTGAGA ACATGAGGTG TTTGGTTTTC TGTTCCTGCC TTAGCTGTTA
200821 ATGTCAGGCC AGAGAGGCTT AAATTTTTAA GGATCTCTGG ACTTTTCTTC TACATTACTC
200881 TTGATGTTTA TAAATGTTAC AACTTCTTTA ATTTCATTTA ATGTATACCT TATTGAGTTG
200941 ATTTAACTGA GTTAACTTTG TTATATGAAA ATCATGATTG GGAGTGAGGG GGTTAAACCA
201001 GCTACAGAGA TCTTGATTGT TGGTGGTGAA GCAATGCAAG AATTCATTCA TTCAGTAAAC
201061 TAATGTTTAT TAAGCGTGTA CTGTCTTAGT CTGTTCAGAC TGCTGTAACA AAATATCATA
201121 AACTGGGTGA CTTATAAACA ACAAAAAATT TATTTCTTAC AGTTCTGGAG GTGGGAAGTC
201181 TAAGATTAAG GCCCTGGCAA ATTTAGTGTC TGGTGAGGAC AGGTAGCCAT CTTTTTGCTG
201241 AGTCCTAACA TGGCAGAAGG GTTGAATAAA CTTCCTTGGG TTTCTTTTAT AAGGACACTA
201301 ATCCTAGTGA TGAGGTTTCT GCCCTCATGG TATAACTACT GCCCAAAGAC CCCTCCTTCT
201361 AATATTATCA CTTTGTGGGT TAGGATTTCA ACATGAGTTT TGAGAGGATA CAGACATTTG
201421 GATCATAGCA CACACCATAG GACAGACACT GTGCCAAGAA TTGTGGATAT AGTGATTCTC
201481 AAAATGAACA AGATCCCCTC AGAGAGCTTG CAAAATCCAG CTATAAAATT ATGCTTTTTA
201541 AACAAATTAT GCAGTTTGAA AAATCTACTC TGAATCTTAC TTGTGGCATT GAATACTTTC
201601 GGCCACTCTT TCCTTATTAT ATTAAATATT TACTCTTGTT TGGGGATCC AGTCTCACCT
201661 ACTTTTTCTA CCAGAACTGG TATCAGCTCA TGCTCTGCCT TATGCAAATT AAGAAAATAT
201721 CATACCTTTT GGGTAAATTA AGCCAAGAAA GTTCTCCTTT CTTCTCTTTC TCTCTTTCTT
201781 TCTTTCTCTC TTTCTCTTTC TTTCTTTCTC TCTCTCTCTT TCTTTCTTTC TTTCTTTCTT
201841 TCTTTCTTTC TTTCTTTCTT TTTCTTTCTG ACAGGGTCTT GCTCTATTGC CTAGGCTGGA
201901 GTGCAGTGGT GCAATCTCAG CTCACTGCAG CCTTGAACTC CAGGGCTCAA GCAATCCTCC
201961 TGAGTAGCTG GGACTATAGG CATGTGCCAC AACATCAAGC TAATTTTTGC ATTTTTTTGT
202021 GGAGACGGGA TCTCCCTATG TTGCTAAGGC TGGTCTTGGA TTCCTGGGCT TATGCGATTC
202081 TCCTGCCTCA GCCTCCCAAA GTCCTGGGAT TACAGGCATG AGCCACTGCC CCTGGCCATT
202141 ATAACTATTT TCATTGGCTT ATCAGGCACA TGATAACTAT AATAAATCAA TAACCAGAAT
202201 TTTTAAATAA AGAAAGGAAG GAATTGTTTC AACTCTTCCT GCTACCCCTC TATCCCTCAA
202261 AAGGGTAGGC TGAATGTTGT CCTCCAAAGA TATCCATGTC CTAATCCCCA GAACCTGTAA
202321 ATATATTACC TTATATGACA AAAGGGACTT TACATGTTTA ATAAGTTAAG AATTTTGAGA
202381 TGGGCAGATT TTCCTGAATT TTGCAGATGG GCCCTAGTGT AATCACAAGG GTCCTTATAA
202441 GAGACAGGCA GAAGAGTCAG AATAAGAGAA AAATACTTCA AGATGTTACA CTGCTGGCTT
202501 TAAGGTGGAG GAAAGGCCAA GAGCCAAAAA ATGCAGTGGT CACTACAAGC TGAAAAGAAA
202561 AAGAAATGGA TTTTCCCCTA AAGCCTCTGG AGGGGCACA ACCTTGCCAA TACCTTGATT
202621 TTGGCTCAGT GAAACCCATT TTGGACTTCT GACCTTTAGA ATTGTAAATA AATAAATAAT
202681 TTTGTGTTGT TTCAAGCCAT CACAGTTGTG GTAATTTACT ACAACAGCAA TAAAATAGAA
202741 TTAAATACAG AGATCTGAGG AGTTGAGTAG GATAAGCCTA CTCCAGCAGG TTATTTCGGG
202801 AGTATGGTGA GACTCACTAG GATGGCGGAA CTCAATTAAG GAAGTCTGAA GCTGATAAGC
202861 CAGAGAGGGA AGGCTCTCAT TTCATTTTAT AAGGGTTGCG TCACACTAGG AAGATCCAAT
202921 AGCAACCACA GTCTCAAAAT TAATGATTAC AAATAGGACA CAATTCCAAG AGTCGGGAGC
202981 CAAGCAGAAA ATGGATTAGG GAAGACATGG ATGATATGAA ACAGGAAGGA GGGGTACAAG
203041 GCAGCTTCCT GGGAAGTTGC CAGGGCAGTC ACAGTTCACA TTCATTAGGC TGTGGGCACC
203101 AAATGCATAT GGAAAATCTA GCTGACTTAA CTGAACTCCT GAAGAGGAAT GAACACCTCA
203161 TTTATTGAGG AGCTACTACC AATTAGAATA TGTATTTCAT TTGTTCAATA ACCCCATGAG
203221 TACAGTAACA CAATCCTTGC TTTACTAAAG CGGAAGCCAA TTCAAGAGG TTCAGTGACT
203281 TGTCCAAGCT CAGGGAAAAC ACTAGGAAGT GAATATGGGT CTGACTCCAT CACTGATTTC
203341 AGGAGCCCTG CCCTTTCCTC CACACCATGC CCCCTTGCTT TCAGAAAAAA AGGCTTGTTG
203401 ACTGAATGGT TGTATGCACA GTTCAAAGCA GAAACACACG ATGACATCTT TTGAGATACT
203461 CTAACAGTGA GAACTTGAAA ATGAAGTTAA AAATTAAGCG GCAAAACCAA GCCGAGGCTT
203521 TCTGAGAAAG TGGGGCCAAA CCTGTTGCCG TCTGACTGCC ACGTGGCTCA CTATTTATCC
203581 CTGTAAAAAT CTGCAAAAGT ATTTGAAAGG GAAGAAGGGA CAGAAAACTC CCTCCTTTTC
203641 CAAGTTAGCC TTATAGTCTA GGGCTTAAAA TACTGGTTTA ATGGTGAAGG TAAGTGCTTT
203701 TCTTCTTTTT GGGTAGAAGG ATTATTACTA ACTTACCAAA GGTCCATTAA GGGGAGGGAA
203761 CAGTTTTAGG AGAAGTCAGA GAAAAGACAT TAACAGCAAC ATAAGGATCT CCATCTGGTA
203821 ATATTGCCTA ATTCCAAAAT GAAGAGACTC TCTGAAAAAG ATAACTGATT CAATGAAGAC
203881 CCTAGGGCAA GGCTTGAGAA GCCACTGGTA CCAATGGACA CTGTGGACAA TGGTCATTTC
203941 TCCAAGGACG CTGTGAGTAT TAACTGTGAT GCTGTGATTA GTCAGACTGG GATTGGCTGT
```

```
204001  GGAATGAAAT ACTGATCAGA ACTGACAAGA TTTGTGTTTG GGACTGTGGC TAACGAGTCT
204061  TTTCAGACTT CTATATGAAT TTGAAATGGT CTCTCAGGAA AAGGAGAACA TGGCCGGGCC
204121  TGGTGGCTCA CGCCTGTAAT CCCAGCACTT TGCAGGCTG AGGCGGGCAG ATCACTTGAG
204181  GTCAGGAGTT TGAGACCAGC CTGGCCAACA TGGTGAAACC CTGTCTCCAC TAAAAATACA
204241  AAAATTAGCA GGGCGTAGCG GCGCGTGCAC CTATGCGCAT GCATAGTGCG CGTGCCAGCT
204301  ATTCAGAAGG CTGAGGCAGG AGAATTGCTT GAACCCAGGA CGTAGAGGTT GCAGTAGTTG
204361  AGATCATACC ACTGCACTCC AGCCTAGGTG ACAGAGTAAG ACTCTGTCTC AAAAAAATAA
204421  TAATAATAAA AGAAAAGGAG AACATGACCA AAGTTATGAA TAAGACTGAA GGCAAGAAAA
204481  TTGTACGCTT GTAGAGATCA CCTAGCTTGT TGCCCTCATT GTACAGCTAA GAAAAGGCAC
204541  CCAGGGACAT TGTGGTCAGC ACCAATTTCT CAGAAAGATA GGCAGATGAT GAGAGGGCCC
204601  TCAGTTTTTC TAACACTGAA GGAATTGCTT CTATGTTTTC TGGTGAACTC CTCCCCACTC
204661  ATCTTGAGGA TTCCAGGCCA GAAGAATCCA CTTTAAAAAA GAAACATTTA AAACCAATTT
204721  AACAACCAAT CAAAGGCACT TTATAGAAA TACATTTCAT TTGCTGTAGG CCTGTATTTA
204781  TGGATCTGAG AGGGCTAGAC TGCCAATATT GTGACTGTTT ATTATTATTG CTGTTGCTAG
204841  TATCTAGAAT ATTATACAAC ATATAACACT TTGCAATTTA CGAGGCATGT CTCATACTTT
204901  TGTTTTCACT CCAAACTGCC CAGTGAAGTA ACATTATCCC AATTCTTCCT ATGAAACAGT
204961  GAAAGCCCTA AGAGTTTTTG AAACTTTACC TGGTTTACTC AATTTGGGAA TGGCAGAGCA
205021  GAATTCAGTC CTTGAATATC CTCCCACTGC AGGTTCATGC TCTTTGATCT AGGTGTAACA
205081  TTTACTCTGA GTAAACTAGG ACTCTGGGCT AACAGAGATG AAGCAAGACA GGCTGGATAT
205141  TAGGAGAATC TAAGAGCAAT CTAACGACCA TTATAATAAA ATCATGAGTT CTAGACTTAA
205201  AAAAAGGGAA AAACCTGTTT TTTTGCTTAT GCGTATACCA TAATATTTAC ATTATTTATT
205261  TTTTTCTCAA ATTCAACCTA TACTGTGTCA AGTAATTTTT TTAATATAA CATTTTCCTT
205321  TAACTTAATT TCAATTCATT TTTCTGTGTC TACTTACAAC TTTGGCACTA GAATTCACAA
205381  TTTTTTTTTA GAGGTATATC TCCTTAAAGG GAAGGGTTCT GACACTGTTA CATGTTCTCA
205441  ATTGTTGCA AATAGGTTAA TAATTATTCC AGTGTCTCTA AGTACATATC AACCATGCCA
205501  GTGTTCAGCC TCCATAATTT TATTAGCTTC TGTGCTTATT TTGGAAAAAC ATTTCCCATT
205561  ACCATGAAAG ACCTCAGTTT AGGATGGTTT GGTATGTTAG CCTGATTTCT GCATTCGTCT
205621  CATGCAAAGG AAAATAGGAA ACGAAGAACT GAAATTACCT ATTGATACAA AATCAAAGTA
205681  GCATTTGAAA CCATAAAACT TAAGTAGGGC TTTTCATCCT TTCTCGTTAG ACAGCAACAG
205741  AGAATGGGAA GAAAAACTAA AGTGATGGGT TTGTGATACA ATTCCAGTAA CATAAAGAGC
205801  AAGGAGAAGT AGTTTTGTTG TGTTTATGTT TAATATTCAA AGCTCAACCT AAAAGTATTT
205861  TTCATTATCA AACTTCCTTC TAGAATAAAT GATTAAAACT TGATTTAAAA TATACAAATT
205921  CTCCTTTATA ATACCTCAAA ATGGAGCTAC CCCATTGAGT TTTAAGCTTG TGATTAAAAT
205981  ATTACGAAAA CAAAGGGGAA GTTGTAATAG GTAGAACAAG CAGTAGTCTA GGCATTAGGG
206041  GATCTGGTGC TGGCTCTGTG CATCATGTGG TTTCAGGCAA CTTTTCAAAT TTTCTACGCA
206101  AATTTTCTTA TCAATAAAAT AAACAGTTGG GCCAGAGGAT CTCTGAGTCT CTTTCAGCTT
206161  TCAGTGTTTA TAAGATTGGA GAAGTTGGTG GGAAAGCTTT AAGTGGAGTG TAAGTAATTG
206221  CAGCTGCATG TACAGTTAAA GAGTTGCCTT CAGCCAAGCC ACGGGATCTT GCATAAAAAG
206281  TGAAATCAAA TAGAAAATGG TCCAAACTCT GGGTTTGACC ACAGATGACT TCAGCTAGGA
206341  TCTGAGTGTA GAGCAATGAG CTGAACTCCT GATATCCAGA TGTTAGCAAG ACTTGGAGGC
206401  CTTCTAAGGC AGAGCAACAA CCAGTATCTG TCCTGGTGCT GACCTGATCT TACTAGCAAT
206461  TGGGCCTCCA TTTGGGTCCA TTGTACAAAA CAACAACAAC AACAACAATA AAATCTCCAA
206521  ACACCCAAAA TTCAAAATTT AGATGGAGAG ATACTATTCC CAGAATTCTA GAGATATTTG
206581  GAAAGCAGAA AACTATACTT GCCATGCTGA TGAAGTCCAA TTATTGCTCT TTTAAATACA
206641  TTTAGCTACT CTGAATATA AAATGAGTAT CTACTAATTA TTTACAAAAT CACTTGGTAA
206701  ATATAGAAAG TCACAAAGAA TGAAGTGATC ATCCTGTTTT GTAACCCAGA AATAGTCATT
206761  ACTGGCACTT GTGTGAATCA GTTTCTATTC CTGTATGTGG ATGTGCACAG CGTATCCTGC
206821  TTTGTACACT AGAGTACTAG CATTTTTCTA ATGTAATTCA ATATTGTCGA AAACATTTTA
206881  AAATAGCTTC CATCACAATA ATCTATCAAA TTGACTTGCC AGACTCTCAT TATTAGGTTA
206941  ATTTATCTCT AACATTATGC AGTCATGAGT AATACTACAA AGGATATTTT TGGACACAAT
207001  TTTTCATCTA TGCCTTTCTT TATAATCCTT CATCCTAAGG TCACAGATTA TGAATATCTT
207061  TAAAGTACGG ACAAGTCTTT TAAATTTGT GTGCAAAAAC AGTGCAAAGC CTTGAATGAT
207121  AAAATAGAGG TTTGATATAT GTGTTTTTTT GTTTGTTTGT TTTGAGACGG ATTCCTGCTC
207181  TGTCCCCCAA GCTGTAGTGC AGTGGCACGA TCTTGGCTCA CTGCAACCTT TGCCTCTTGG
```

```
207241 GTTCAAGCAA TTATCCTGCC TCAGCCTCCT TAGTAGCAGG GTCTACAGGC ATGTGCCACC
207301 ACACCCGGCT GTTTTTGTAT TTTTAGTAGA GATGGGGTTT CACCATGTTG GCCAGGATGA
207361 TCTCGAACAC CTGACCTCAA GTGATCCACC CACCTCAGTC TCCCAAAGTG CTGGGATTAC
207421 AGGTGTGAGC CACTGCACCC GGCCGATACA TGTGTTTTTA AAGTCACAGA AATTTCAGAT
207481 GTCTTGAAGG ATTTTAAGCA ATTTAAAAAA TAAAGTCATA GAAGCTTCAA TTTAGGAATG
207541 AATGGAAAAT TGATGATATT CTTAGGATAT GGATTTTTCC TAAAAGAAAC AAATGTATGC
207601 ATCCCCAAAG ATAATTTGAT TAGTATACAA ATATTAAATT AAACATGTCC ATATTTAGAG
207661 CCATGAATTC TCTTTGCCTG TCACAATAGC TGGATTTATT CACAATTGTA GTAATTAGTC
207721 CCTGTTCATT ATAATTTTCT AGGTGATATG AAGACTTTGT CAGTCCAAGC AAGTGTCCAC
207781 ATTGTGTGTA GCAAACATGA GAATAAACAT TTTAAACTTT TAAATGTAAT ACATATTAGT
207841 GTTATGTAAT GTCATCCTTC ATGTTCGAAG GCACATGGAA CATTGTTCTG GTGGTACAGA
207901 GGGGAGAGAA ACACCATCAG AATGAAAGGA AGACCGCTC TGGAACCTTC CTCCTTAGCT
207961 CTTGAGCTTA GTTTAATTGT CCTGTCTTAT GGTCTGCTAC AAGCAATACC ACTCTTCACC
208021 TTCGCATGCT TCTCTGTGGT TTGATAAAGT ACATGCAATT TTTCATTTAA TTCTTCCAGC
208081 TGCACTAAGA AAGGAGCCTT ATCTTTATTG AACAGATGAG GAAATGAATG ATTAGAGAAT
208141 TTAAATGACT AGCTCTAGGT CACACAGCTG AACTTACAG CCAGATTTCC TTTTAACAAT
208201 CCTGTAACCA AAAGCATACC AGTAGTGCCC CATAAAATGT AAGTTATAGA GCTGTGTTGG
208261 GTCAAAACTT TTACTGATGC TAAGAGGAGG CAACATTAAC AAGGGGAAAT TATTTGTGTA
208321 TTATGTTTTG GATTATGTTC TCTCCATAGA TAAAAGACTG TCGTAGTAAA AGAGATTCAG
208381 GGCACAGGGA AACTCCACCA CAAAGCGTGG TACCATTTCC CACAGAAGCT AAATGGACGG
208441 GAAGCCTGCC ACCAGGAAAG GTAAAGCCAC TGCTCTTGTT TGCAGGCTAT GTTAATAAGC
208501 TGAAGCTTAT TCCGACACAT TTACACATCT CTGCATCACA CTGACCCTTC GTAAAGATAC
208561 TCCCAGTGTA ACATTGGAGC CAGCTCCAGC CCCTGATCCT GTTGCTTTTT CCTTAGCCCC
208621 ATGAAATCAT CTGTGAGAAA TTAAGCCAAA TAAGCAATAA ATCCTGGGAT CTAGGGAGTG
208681 GAATAAGTTT TGGGAAAGTC TTTTTTTTTT TTTTTTTGA CTGAGTCTTG CTCTGTCTCA
208741 CAGGCTGGAG TGCAGTGGTG CGATCTCGGC TCACTGCAAC CTCTGCCTCC CGGGTTCAAG
208801 TGATTCTCCT GCCTCAGCCT CCCGAGTAGC TTGGACTACA GGCACACACC ACCATGCCCA
208861 GATGAATTTT TGTATTTTA GTAGAGATGG AGTTTCGCCG TGTTAGCCAG GATGGTCTCG
208921 ATCTCCTGAC CTCGTGATCC ACCGGCCTCG GCCTCCCAAA GTGCTGGGAT TACAGGCATG
208981 GGCCACCACG CCTGGCCCGG GAAAGTCATT TTAAACCAAC CTATGTATGA ATCCCTACTA
209041 TAATATTCTC ACCAAGCGGC TGGCTCTTTC TCCTGAGCTT GGAAACCTCC AGTAAAATGG
209101 AAATAATTAT TTCCCAGACC ACCACTCTTA TCTGTGAGCT TTTTTGGCCA TTAAAAATTA
209161 TTTCTTCCAT TATATTTTA TCTGTGTCTT CACAGGTTTT CTCTTTCTTT CACTTTAGTG
209221 CTTTTCTTCA AATAAGCAGG AAAAATCCAA TCTATCATGC ACATGGGAAC CCTTTCAATA
209281 TTGGTCTGTG GTTGTTCCAT TTTATGGGGA TGCTTTTAAA GAAAAAATTT GTCCTTTCAA
209341 TATATTGAAT ATCTTCCAGC ACCACATCAC CTGCAAGCTT TGTAAAAATA GTTCTACATA
209401 TTAATTTTTT TTTTTTTTTT GAGATTGAGT CTCATTCTGT CACCCAGGCT GGAGTACAGT
209461 GACATGATCT TGGCTCATTG CAACCTCTGC CTCCTGGGTT CAAGTGATTC TCCTGACTCA
209521 GCCTCCCGAG TAGCTGGGAT TACAGGCATG CATCACCATG CCTGGGTAAT TTTTGTATTT
209581 TTAGTAGAGA TGGGGTTTCA CCATGTTGAC CAGGCTGGTC TCAAACTCCT GACCTCAAGT
209641 GATCCACCTG CCTTAGCCTC CCAAAATGCT GGGACTACAG GCGTGAGCCA CTGCACCCCA
209701 CGTAGTTTTT TTTTTTTTTT AAGTTGAACA TATGTGAAGG CAGGACCTAG TGACACATAG
209761 CAATAACATT TCCAAGTAGA CATTACACTA GGGAATTAGT CGAAGTGCTC ATTTAAAGTA
209821 CCATCTCTCA AATGTATTAA AAGAGAATCC TTGGATGTGC AATACCTTAA TTCAAAGGCA
209881 GCTCGTTATG TATAAACTCT CAAGCTTTGT GATAAACAAA TGTGCATAAC AGATGGGACT
209941 ATTCACTTAC AGCCCAGGGA ATTTTATTGA CGCTGAGAAG GTTATGTGAC TGGCTCTGCC
210001 ACTGTCATCC CCATTCACTT CATTTTGGAG CAATATGACA TAAATGCCTT ACATGTGGGT
210061 TTTCTCTATT TATCATGTGT TTCCTATCCC CTTGAAAGAT GGCCATATTT GCTTTACTTG
210121 GTTATAAGAT CCCATATTCG CTGTCTTGAA GCCAACCAAA TAATTTGACA AAGTGGGTTT
210181 GTAGTGCTGG CTATTTTGGT GAAAAAAGA CAATGAGACT TCATGTGTCA TCCAAAGTTC
210241 TATCAGATCG AGCTGTGAGA GAAAGGAAAA GAAAGGGGTC TCAGTCAGGA TGCTCACTAC
210301 ATACATCTGT GTTGTTGTCT AGGTCCAGAT TTCTGTTCAT TACGCTATGG GCTGGCTCTT
210361 ATCATGCACT TCTCAAACTT CACCATGATA ACGCAGCGTG TGAGTCTGAG CATTGCGATC
210421 ATCGCCATGG TGAACACCAC TCAGCAGCAA GGTCTATCTA ATGCCTCCAC TGAGGGGCCT
```

```
210481  GTTGCAGATG CCTTCAATAA CTCCAGCATA TCCATCAAGG AATTTGATAC AAAGGTAAGT
210541  ATGATGGAAA ATAGGGCTCT TGTTGAGAG AAAAAACTTT GAAAGGAAGG CATAGATCTT
210601  GATTCTGTGG AGTATGAAG TATACATTTC CAATGACAAA TTAAAACTGA CTGGAACTAT
210661  TTTTCTTTGA GACATTGCTT ACTTCAATAA TAAAAATAAG ATTTCATTGA GGTTATTATG
210721  ATTATAAGGT GGGGGAACTG TAGAGTTAAA TGTGAAAAAT TTAAAAATGG AACAGTTTAT
210781  GTGATGTCTT CAATGAAAAA CTAGGTATTA CCTGGGCACA TTCTTATAGG TTACTCAATC
210841  CTATTCAGTT CTCTGCCTGT TTTATTGTTT CTGAGCAATT TTATATCCCT GTAAATTCTA
210901  TATAACCAAT AGAAATGCAA ACGATTCTTG TCCATAGCTT GCAAATAAA TTTTGCCAAG
210961  AGAAAAATCA GTTAAAACTT TTCTCCACTC ACCTCCCAGT TGAATTAGCC AATTTGCTG
211021  TTTGTTGTT TGTTTGTTTT TTGAGATAGA GTCTTCCTCT GTCATTCAGG CTGGAGTGCA
211081  GTGGCATGAT CTCAGCTCAC TGCAGCCTCC GCCTCCCGGG TTCAAGAGAT TTTCCTGTCT
211141  CGGCCTCCCA AGTAGCTGGG AGTAAGGGGG CATGCCACCG CGGCTGGCTA ATTTTTGTAT
211201  TTTTAGTAGA GACAGGGTTT CACTAGGCTG GTCTCGAACT CCTGACCTCA GGTGATCCAC
211261  CCGCCTCGGC CTCCCAAAGT GTTGGGATTA CAGGTGTGAG CCACTGTGCC AGGCTCTGCT
211321  GTATATTTAA AGTCTATTTC AGCATTGCTT CCTGCTTGTG TTATGCGTGA TTCTTTGAGT
211381  TTTCCTTTGA ACCAGTTATA ACATCTTACT TACTTCCTCC ATTAATCAAT GAGTTAAATA
211441  AAATCTTTGT TGTATGTTTA TTTTACATTT ATATGAAAAC CATGAATTTA CCCAATTAAA
211501  AAAATTATCC TTTAAATTAT CTTGTACTGT ACATTTCCCA TGTCATCCCT ATAATTCATG
211561  ATTAATGATT TTATTACATT GGACCTAGCT TATTTACAAT GAGTACATAA ATTTATTGTC
211621  TCCAGTCTTT CCTCCATTAT CCCGTCTACA TATCCACACT GAGTAGATTC ACTACTCAGG
211681  AATCTTGGAC ACCTTCAAGT TGCCAAACAT GCAGTGTTCA CTGGACATGC TGTGTTCCTT
211741  CAGAATTTGG GCCTGCTTCT CAGCACACTC ACATCTGCTA TCAATGACCC ATGGAAAGTT
211801  TTTGCCCTGA GCAAGCCAGA GTCCCTGTTA GTTTCTTCCA AATGCTACAA GTTCACTTTT
211861  GCTATTTTTT CCGATGAGAT AAAATTTTCC TTTTGACTT TCTACAAATC ATAGTCATTT
211921  TTCAAGGGAT AGTTCAAGTA TTGCTTCCTT TCTGGGACCT TCCCAAATTA TTATTTTCTC
211981  CTCTCAAAGT CTCTGTTTTA TTTATGTTCA TCCTCAAATC TTGATTCTCA CATGAATCAT
212041  ATACCTTGTA TTATTTATAG TTTTTTTGAG TGGGTAAAAT ATTTCATATT TTATATTCTT
212101  TGGCTCTCTA CTTTATAGCA TGATGCCAGA TATTTAGGGG CCTTATTGCA TTTATTTTTT
212161  ATTTTATTTT AAAATCTATT TTATTTTTA TTTATTTATT TTAAAATCTA TTTATTTTTA
212221  GGTAAATATT CAGGTAATAT AATTTATGTA ATTATTTAGG AATTTTAGGT AGTTATTTTA
212281  AAATAATTCA AATTATTTAT TGAGTTATAT CAGAAGAATG TGATCTTATT CATTTGTAAT
212341  ATGTGTTTTA GGAACTCAGT TCAGCCAGGG CAGACCATGA TTCCCAAACT TGACTTTTCT
212401  TTTTAATTAG GCACTGATTT TGGTTAAGAG TTCAGTAAAG TTTTGTGTGT GTGTTTTAAA
212461  AAATTCTTTG ATATAAGAGT CAAGATGTTA CTCAACTTTT ACTAGAAGCA AAATAGAGGA
212521  AGTGCTTTCA CAGATGAAAT ATCTCTCAAT GTTTTCTTCC ATTTACTTCT TCCTATTATT
212581  CATCTATATA ATCATTTTCT TTACCTCTTT TCTTCATTTC TTCTGTTTTT CTCTCCTTCT
212641  ACTAAGACAA GCAAATTAGG GGTATAATTG GTTATTTGGG AAGGTAGGAA GAATATAGAG
212701  AGAAACAAAA ATCAATATTT TATACTAGGG TCTCACTAAC CTCAAGCAAC TCTGACTGTA
212761  AAGTAGATTT TCATAATAGG ACTTCTTGAC AAAGAGTTTT CCTATTTTTC CCCCAGGCCT
212821  CTGTGTATCA ATGGAGCCCA GAAACTCAGG GTATCATCTT TAGCTCCATC AACTATGGGA
212881  TAATACTGAC TCTGATCCCA AGTGGATATT TAGCAGGGAT ATTTGGAGCA AAAAAAATGC
212941  TTGGTGCTGG TTTGCTGATC TCTTCCCTTC TCACCCTCTT TACACCACTG GCTGCTGACT
213001  TCGGAGTGAT TTTGGTCATC ATGGTTCGGA CAGTCCAGGG CTTGGCCCAG GTATCCAGAT
213061  ACTTTCTCAT TCTTGGTGGG ATCCAGATTT CTGAATTCTA CAAAATATCA AAGGTCTTAA
213121  TGATTTTCAT TTCAGGGAAT GGCATGGACA GGTCAGTTTA CTATTTGGGC AAAGTGGGCT
213181  CCTCCACTTG AACGAAGCAA GCTCACCACC ATTGCAGGAT CAGGTAAGTG TGCACAGATG
213241  GGTCATAGCT TTGTCATCTG TTCCATCCCA CTGTGTCTTA TCTTCTATGA ATCAAATGGT
213301  TTGGGGAAGA GAGAGAAAAA GTACTGCTGA AAAATTCAAC AATATAAGAC ACTTGCATCA
213361  CAAATAGGAA AGATGCATCT GTGCAGTAAA GACATTGAAG CTTAGAAGTA GAAAAACCA
213421  TTGTGAGCTA GGTTTCAGCT CAGAAAAGCC TTAGTAGTCA GAAAAGCCTT AGTAGTCAGA
213481  AAAGCCTTGT CGGAAAAAGT TTAAACCTTT AAGAATTGCA CACATGGAAA AAGATCAAGT
213541  AAGCTATATA TACACCATCT TAGCAATGAT TTGAAGTGA GAATTAAGGC TACCACAGCT
213601  CCAGGTGGTA AGGAGAGAAA TCAGGCTGGA AGAGTTTGAA GTTTCTGTAT TATTCTAAGC
213661  TCTTTACTAT TCTATTATGA GCTCATTAAT TCTCACAACA ACCCTCTCAT ATAAGTACCA
```

```
213721 TTTTAAATTC TTATTTTACA GAGAAGGGAG TTAAGGAAGG TGGAGATTAA GAAAATTGCC
213781 CAAATACAAA TAGCCAGCAG GTGGTAGGTC TGAGATTTAA GCCCATGCAG ATTTTAGCCC
213841 CAGAGCAGAC ATTCTCAATC ACTATGCTAG ACTGCCTTTC CATGGTATGT GATCCTACTC
213901 AGGCCTCTAC AGCTTTATCA TTGCTGTTCT CCCCAGCCTG TCGTGCTGAG AGTATATACT
213961 CGAAGAGCAG AACTAAAATT CCATCCAGCT TCTCACTCCT AGGTCCACTA CACAGCTGCA
214021 TCCTGCAGAC TTTTACCTCA AGCAACCCTC CTGCGTTCTT GCTTCCTTCC ATCATAGTTG
214081 TAACCATCTC CTCTATTTGC AAATACTATC TGCTGATCTC TCTCTTCTAG ACTGGTTTCT
214141 TTCAACCTTC TTCCCACCAA AACCAAGTTA GCTTGCTAAA ATAAAGATGG CACATTTTTA
214201 CTCACCCGCT TGAGAATTTT CAATGTGTTC CTTCATGCTT ACAGAGTAAA GCCTGACCTC
214261 TTTATTGCAT GAATACAAAA GTTCTTAGCC ATCTGGCCCC AACCTTGTTC CACTCAACTC
214321 CCCTGTGCAA GCATGGCTCC AGTGGCACTG GACATTGGCT GCTCTCCACA TAGATCTGCA
214381 CTGCACTTCC CTCTGGCTCT GCTCCCGTTA GTTTATATGC CTGGAAAGTT CTTTGCCCCT
214441 GTTCCTTGTG CCAAAATTCC ATCTATCCTA TTGCATAGCT TATGTAAAAA CTTCCTAAAC
214501 CTTTTTTTTT TTTTTTTTTT TTTTTTTTTG AGACGGTGTC TCACTCTTTC GCCCAGGCCG
214561 GACTGCAGTA GCGCTATCTC GGCTCACTGC AAGCTCCGCC TCCCGGGTTC ACGCCATTTT
214621 CCTGCCTCAG CCTCCCGAGT AGCTGGGACT ACAGGCGCCT GCCACCATGA CCGGCTAATT
214681 TTTTGTATTT TTAGTAGAGA CGGGGTTTCA AGCCAGGATG GTCTCAATCT CCTGACCTCG
214741 TGATCCGCCC GCCTCGGCCT CCCAAAGTGC TGGGATTACA GGCGTGAGCC ACCGCGCCCG
214801 GCCAAAACTT CCTAAATCTT ATAATTATTA TCAATTTATC CTCAGATATA CTTCCACGTA
214861 CATTGTAGTT TTATTATATT TATATTTTAC ATCTTTTTTT TCAAATTTCA GTTTGGGACC
214921 CATTAGTGAG TCATAAAATC CATTGAGCGG GTTAAAATCA TTATTTTAAA AAATGAATAG
214981 AATAGAATAG AAATTGTTGG AGTGCATTGG ACATGGTAAA GTTAAATATC GATTCATGAA
215041 ACCATCGTTT GAGGCATATG TGTGTGGTTG TATGTACAAG TGTTTATGCA TATTGGTGTG
215101 TGTGTTATGT TACCCTGTAA AATGCATTTC TTACTATAGG TCTCTGTGAA ATATGTGTCT
215161 TGTTGTTTTT TAATGTAGAC TTCCAAAGCC TACATGGCAT TTCACTAGTG ACAATCAATT
215221 TTATTCACAT TTTTCTCTCC AATTGGACCA GAAGCTCTTT GAGGGCAGGG GCTGTATCTT
215281 ACCGATTTTT GTAAGTCTTT CATTTCCTGC CCCTAGCCTC ATATTAGATC ATGCAAGAAT
215341 GCAACTGTAA TCACAAGAAA ATGCTAATGG GCTGTGATAG CAGAGAGTTA CTGTGACAAA
215401 CTAAGGGATT TAGATTTGGT CACATTGGTG TTGAGGAGCC ATTGAAGAAT CAGAGAGTGT
215461 GTTACTATTA TTTGTTAATT TTAATTATAT CATATTACTT TACTGGGGAA AATCTGTGAG
215521 CTATTTTAGA AATAAATACT CTCATTGCCC AATAATTCTA AGTCTGCCAC CTCACTGTTG
215581 GGACATTGTT TAGGGAGGCC ACGAAGTCTC AGCCTTTGAT ATTTTCATAA GTGTTTTTCT
215641 CCCTTTTTCC TTTAGGGTCA GCATTTGGAT CCTTCATCAT CCTCTGTGTG GGGGACTAA
215701 TCTCACAGGC CTTGAGCTGG CCTTTTATCT TCTACATCTT TGGTGAGTCA CTTTCTCTTA
215761 AATCCTAACG CCTCCATTTC CTGAGCATCC ATTTTGGCAC CTACACCACC CACATTCTTC
215821 CTATATGAAA GAAAATGTCC TTTATCAAAT GGAAGATGAT AAAAAATGTC AACGGTTGGT
215881 ATCATTTTTA ATCTAGTCAC ACAACCTGAT TAACACCTTC CTGGTGGTTC TGGGAAGCCA
215941 CACGCACAAG GTAGAGGAGT TGACTATTCA CATGGCACCC ACCGACTTGT GATGCAGTCT
216001 TGTCCTTCCA TATCAAGCAC CTTCTGCAGA ATCTCTACCA CCACATCTGA AGTGCCTGCT
216061 ATATGCAGTT AAGATGTCAA AGATAGTGAA GTACATTTTC AATGTGTCTT CATATTTCAT
216121 TATAATTATT ATTTCTGTCC AAGATGCCTT TCACCTGTTC TCTACCAAGT TAATCTTGCA
216181 AAGTTCAATT CAAATGTTCC CTTCCCATG GGCCCTTCCA GGGCTTACCC TATCAGATTC
216241 TGGCATTCTC TCCTTTATGA TATTTCCTCT CTAGGTTATG TTGGTGTGTA ATTATTTATT
216301 TCTCCTTTTC TTTCCACTAG ACTGTGAAAT GCTTGAGGCA AGGAATCCAT TCTATGTTTT
216361 CATCACTTGG GTGTCATCAT GGTGCCTGAT TTTTAGCTTT AAAATAAAAG AATCAGTGAA
216421 TCCAGTAATT AGAGGGGATT TAAAGAAAAC TAGTCCTCAG AATCTTTTAA CATAGAATGT
216481 TCTTCAAATA AGGAATTCCA ATAATAAGAC AATTTTCTAC ACTTGATTTT GTTTTATAG
216541 CCAAATGGTG TCATTAAATA TAGTCCTGGC CTGAATGGCT TTCTCATTAA TGATGCTAAT
216601 TATTTTGGTT TGTACATGTT AACCAGGTAT TGTACAAAAA TATTTCTTTT GGGAATCCAT
216661 AATGGATGTA TGGCTTGAAT ACAAATAATA CTGTCTCTTG TAAGTGCATT GGAAATTTTT
216721 CCCTGCCACA TGATTTCATG GAAGGTTGTT TCGTGTATGT ATGACTGCAA ACCTGACTAT
216781 TCAGATCTTC CGCAACAAGA CAACTTATGT GTGCATTAAG AAGTTGCTGC CTAAAATACA
216841 TAACACTGTA ATCATTGGAG ACTTTAAAGT AATTAATCAG CTATGCAATG CCACGCTCCT
216901 GTTATCTCCA GAGGGCTCTG ACATTGACAA ATGGTGGCTT TCTATTTGAG ACGTAATATC
```

Figure 1 (Page 67 of 73)

```
216961 TAAAAAGCTT TAACAGGTTT GTAGAAGGAT TGAAAGAAAG AATGGGAACA TTTAGGTCCT
217021 TATGGTAGAA TAAGCATTAA TTGATTAGTG TGTAGAAGGG AGAGGCATGC CACTTCAGAG
217081 GAAACTTCCT TCCCCCAGTA AACAAATCTA CCTAAAAACT AATTTTATCC CTTCTTCCCA
217141 GGTAGCACTG GCTGTGTCTG CTGTCTCCTA TGGTTCACAG TGATTTATGA TGACCCCATG
217201 CATCACCCGT GCATAAGTGT TAGGGAAAAG GAGCACATCC TGTCCTCACT GGCTCAACAG
217261 GTACAGTGCA CACCTTGTAC CTGTGGCCCA TGCAGAGGTC TCTAGGGCAG GGTGTGGATC
217321 TCCTCTGAGA GGCACCATCT TGGCTGCTCT AATACTCATG CTGATTAGAT CTTTCTTTTC
217381 AGCCCAGTTC TCCTGGACGA GCTGTCCCCA TAAAGGCGAT GGTCACATGC CTACCACTTT
217441 GGGCCATTTT CCTGGGTTTT TTCAGCCATT TCTGGTTGTG CACCATCATC CTAACATACC
217501 TACCAACGTA TATCAGTACT CTGCTCCATG TTAACATCAG AGATGTGAGT TTACTTCCTA
217561 TACTTCTACG AAAATGATAA TGGTAATAAG GAGAAACAGT TCTGTGTTAC CTATTACATT
217621 CTGGCTTTAC ATATAACCAT TAATTTAACC TTCACAATGA CCTTGAGAGA GGCATTGTTA
217681 TAATTCCCTT TTCACAGATG TGGAAACAGG ACACTTAGAG GTGAGATAAC TTGCCCCAGG
217741 TTGCACAATA CTAAGTGATA GAGCTGCTGC AGCATCCATA TTCTTAACCA CTATGCTATA
217801 CTACCACACC AGCTGATTCC AAAGCTTCTT TTAGAAATAA TATTGCTGGG CCAGGCATGG
217861 TGGCTCATGC CTGTAATTCC AGCACTTTGG GAGGCCGAGG CAGGCAGATC ATGAGGTCAG
217921 GAATGCAAGA CCAGCCTGAC CAATATGGTT TACTAAATAT CATCTACTAA AAATACAAAA
217981 ATTAGCCAGG TGTGGTGGCA GGCACCTGTA ATCCCAGCTA TTCAGGAGGC TGAGACAGGA
218041 GAATCGCTTG AACCCAGGAG GTGGAGGTTG CATTGAGCCA AGATCATGCC ACTGCACTCC
218101 AGCCTGGGCG ACAGAGTAAG ACTCCGTTTC AAAAACAAAA AACCCAAGAA ATTAATATTG
218161 CTTTTATCTG GAGCCCAGAG TGATGCAGCT TCTGGCCCTC TTATCTGAGA CAGTGTTCTT
218221 TTAGTGTGAA AAAGGATGCT AATTTTCCCC CAAACAACCC ACAGTATCAT GGGGGTAAGT
218281 TAATGGCTGG TCTGTGTAAC TGACAAATTT TGGTGCTAAC GTATCTCTAT AACTACTCTG
218341 TATAAACTTC CTTCCTTCAG AGTGGAGTTC TGTCCTCCCT GCCTTTTATT GCTGCTGCAA
218401 GCTGTACAAT TTTAGGAGGT CAGCTGGCAG ATTTCCTTTT GTCCAGGAAT CTTCTCAGAT
218461 TGATCACTGT GCGAAAGCTC TTTTCATCTC TTGGTAAGGA TAAGCGTGTG GGCCCATTTA
218521 ACCAATCCCT TTTCTGCACA TGGTCTCAGA GGGTTCCCTG ACAGCATGTC CTCATTGCCC
218581 AGGGCTCCTC CTTCCATCAA TATGTGCTGT GGCCCTGCCC TTTGTGGCCT CCAGTTACGT
218641 GATAACCATT ATTTTGCTGA TACTTATTCC TGGGACCAGT AACCTATGTG ACTCAGGGTT
218701 TATCATCAAC ACCTTAGATA TCGCCCCCAG GTAAGAGCTC TACCTGTTTT TTCCCCTCCT
218761 CCAGACCCCT CCAGAGGTGT TAGACCTCAG TGGTCGCCGT GAAACTCTTT AATGTTACTG
218821 ACATTGCACT AATGGCAGAA TGACAAATAA CTACAAATAT CTGTCTGTGG CCATTTTTAG
218881 AACAACAAAT GTGGCATTTT TAGAACAACA ATTTCCAATC TTGGCCAGTA ATCATTTTGA
218941 CAAAAACCTT CCCAAGCTTC CCTAACAGAG ATTGAACTGT GTATGCTGGG AAAAGGCCCA
219001 CACACAGGTG ATTTGGAAAA GTTTCCATGG TGTTGTTCAT ATTAGCTACC ATATATATAT
219061 ATATATATAT ATATATATAT ATACAGTCAC AATAAGCCAG CTCCTGTGCC AAGACTTGCC
219121 ATATATCAAC ACATCTAATC CTCACAGTTA TATTAGGTAG GCCCATTGT TATCCCCATT
219181 TTATAAGGGA GAAGGCTGAG GCACAAGGAG GTTAAATGGT GTGACTATGG TCACATAAAG
219241 GCAGAGCCAG GATTTGGACT GGGGGAGTCT GGCTTTGGAG TCTGTGTCCT GCCCGTTGCA
219301 CAAACTGGCT TCTCCACTGA GCAGCCGGGG TAAAGAAACG TGGTTCCCAG AGAGACTGCA
219361 TTGCTCCCTG GTTATTGACT TGGTAGATTG GTAATTTCAG GTTTGGCAAA TAGACATTGC
219421 CCTGAATGTC TTTAGGTGAA TGAAAAACTG CATTAAGCAA AATGACTTTG CCATTAGAGC
219481 TGAATTGCAT TAAAGTTGAG TTGCTGCAGA AGCTGTAGGT GGCTTTCTAT ATAAAATCAT
219541 TTATAAAATC ATCTTCCCAC AGATATGCAA GTTTCCTCAT GGGAATCTCA AGGGGATTTG
219601 GGCTCATCGC AGGAATCATC TCTTCCACTG CCACTGGATT CCTCATCAGT CAGGTTGGGC
219661 CAGTTTATTG AACATCTTCA AGTGGCAGGT ATTGTTTAG GTGTTGGAGA TACACACGGT
219721 GCTCTAAAGA TCTGGATGGC AACACAATTA CTCTATTTAC ATGAGCCTCT AAATCAGACT
219781 CTGGTAGGTC AGATTTCCCA GAGGAAGAAA AATATAAGCT TATTTTCTCA AGATGAATAG
219841 ATGTTAGATT GATTAAAATG AGCTGTTCCG GTGCAGAAGA CAGCACGTGT GACTTCCTAG
219901 AGGTACATGA GCATGAAACA GTTCTTAGTT ATGACCAGAA TGAAAGACAC ATGTCAAGGA
219961 ATAGCAAGAG ACGAAGACAG AGGGGCAAAA GAAGATCATG AAGAATATGT TCAGACTAAT
220021 CCAATTTTTA AAAAATCACA AAAGGGAAAC AAAGTGTCCT AGGCCAGTTT AAAGATAATT
220081 TAATGTCTGG AAACAGATCG GCTGTGAGAC ATTGCAAGGA GGCTTGCTCG GTGTTTGGAA
220141 ATGCAGGCTC ATGAGGAAGA TGAAAAGACA GACCCAGGCA GGGATGGAAG GACTGACGAG
```

Figure 1 (Page 68 of 73)

```
220201 AACCAACTTA CAAAGAGAAG TTTTGTTTTT ACTACATTTC TATGTGATCA AGTTCCCAGG
220261 TTAATATTTG ACTAAACTGC TAGGAATCCA CTGTGACTAT AATGCTGGAA ATGACTTAGT
220321 AGGGCTTTCT GAGGAGGGTC ACACAGAAGA CCAAAGAGAA CTCATGTTGA ATTGAGATGG
220381 GTTGTAGTGA TAGTTGTCAA CAGCCAATAC AGAAACAAAA AAAAACAAAA CAAACAGCAA
220441 CAACAACAAC AAAAAAAAAC AGAGAAGACA CAAACACAAT GCCACAATGC CATTTTAGGC
220501 ATAATTTTAA ATGAGTAATA TTATATGTTG AAATCCAAAT TTTCAGAAAA ACATTAGTGT
220561 ATTTTATTTT TGTTTAAAGA AATAACCATC TCAACTCAGA ACCCCATGTG CATTTTGGCC
220621 ATTTTGTTTC CAATAGTTTC ATAAACTTTC TTAAGTAACT ACTGCACATT GTTCCTTATA
220681 TTCCTTGTGA TCAACATTGC AATACACAAC TGGGAGGGCT ACTAGAACTG GTGTAGAAGG
220741 AACTTGTGAG ATTGATCATT TTCTCTGTTT TTTACATCTA GGATTTTGAG TCTGGTTGGA
220801 GGAATGTCTT TTTCCTGTCT GCTGCAGTCA ACATGTTTGG CCTGGTCTTT TACCTCACGT
220861 TTGGACAAGC AGAACTTCAA GACTGGGCCA AAGAGAGGAC CCTTACCCGC CTCTGAGGAC
220921 ATAAAGTTAC AAACTTAAAT GTGGTACTGA GCATGAACTT TTTAAACATT TTTTACTTCT
220981 CTCCATATTC CTGACCATAG ACTCAGCAGT TCTTAACTCT GGCTGTGTGT TAGTCTTCCC
221041 TGGGGAGCCT TTATAAGACA CTGATACTTG GGACCCACTC CAGAGATTCT GAATGAATTG
221101 GTCTGGGGTG GAACCCAGAT ACTACTAATT TTTAGATACT CCTTAGAGGT TTCTAGCATG
221161 CGCCCGGGGT TGACAACAGC TGGACAAACT TGAAAAGTCA ATTCATGTGG CCTTTGAATT
221221 TTCCTCATTG GAAAGTACTA AATAAATAAA AATTCATGTG AAAATGATCA CTGATAAATA
221281 TCTTCATGGT GGGGCAGGTT ATTGGATGCA GAGAAGATCT GCTCGGAATT GTAGCCATAT
221341 GTTACAGATC TCAGCACCGA TCGGAACTGT AAAGCTATAA TCCCCAGAAT TAAAGTTTTT
221401 ATTATTTTTT ATACATTGTA AAACATAGAC GTTTATTTAT GTGATTAAAT TCTATTAAAA
221461 TTTACATGCT AAAATAAAAT AGACCATTTT CAAATTATTT AGATCCAGAT ATTTCCATCA
221521 GATTAAACAG ATATTTATTT ATCCTAGCCC AATTGCAAGA GATTAATGAT GAGAAAATGA
221581 CCAATACAAG ATTAAATAAA TGAGGTTAAC TTAGAAATCA AGGACAGAGA AGATAGAACT
221641 GGAAGGCTTG TATTGTGAGA AGAATGAATG TGAAGGAAGG CAATGTAGAC ACTTCCAGAA
221701 GGGATAGCAA TATAGTTTAG ACCATATAAT GAAAATTGGA GAGAGATGAC AGAGACACTT
221761 TCAAGTGAAA TGACAATTTA TATGGGGGAG AAAAATATTG AAGACATAAC AAGATGAGAA
221821 AAGGCATAGA AATGTATCAC ATACAAGGCA TAGAAGTGTA TCACATACAA GAGAAGTTCC
221881 TTTTGAGCGT AGAAAAAGAT AATTTAACCT TCTTCATATT TTTCTTACTT TCCCAAGATA
221941 CTCAGATAGG CAGCGTCAAC TCTAACAGGA ATTAATTTGG CTCCTAACAC TTAAGACATA
222001 TCCTTTAGTT TGTCTCCTCA CACAGAACTG ATTCTGGTTT TGCCACAACA TGTCTAGAGA
222061 AGAAGTTCCC ACCATATTTT AAATCCTATT AAAAAACTGC TTGGACAAGA ACCTTGGGTT
222121 AATTCAGCAG ATGAAGAGAA TCTCCTAATG CAAATCAATG GTATTTTTG AGCAAGTTTT
222181 TCAGAAAAAC AGAGTGTCAG GCCCTGAGGG TGGTACTAAG ATGAGAACAT TGATTTTGCC
222241 TTCATGATAT TGACAACACA AAGAGGAAAG GGGGTTTGCA GAAAACTAAA AGAAGAAGTA
222301 GAAGAAAAAA GAAAGACATA GTATAATAGG TAGTCAAATT ATGTACAGAA AAAAGAGAAA
222361 AAAAAAACAA AAAAGGGTGG GGACAGACA ACCCAACTAA AAAATGGGCC AATGACTTGA
222421 ACAGGGACTT CATAAAAGAG AAAATGTAAG TGGCTCCTTA ACATATAAAA AGATGTTCAA
222481 CTTCATTAGT CATTACAGAA ATGAAAATCA AAACTACAAT GAAATACCAC TATAAAATTA
222541 ACTAATGGAT AAAATGAAAG GAGATGGAAA ACAAAATGTT GCCAGACATG TGGAGCAACT
222601 GGAACTTTCA TACGTTACGA ATGTGAACTT TGGAAAGCTG CTCGGCAATA TCTCCTAAAG
222661 CTAAATGTAC AATTCCAGTG ACTCAAACAT TTTACTTAGA AATGCACATA TACATCCATA
222721 AAACATGTAC AACAATGTTC ATAGGAGCAC TATCTGTAAT AGCCTGAACA GGAAGTTGTC
222781 TGTTAAAAAA AGAATGAGTA AATAAACCAC GGTCTATTTG TATAGCAATG AGAATTAACA
222841 GACCCCAATA TATAATAGAT GAATGGGTCT CATAAGCACA ATATTGATTA AAGGAAGACA
222901 AAACGCACAT TCTTTTAAAG GTTTATAAAA TACTTTTTAA AAACAGCTAC AACCAATCTG
222961 TCCTGTTAAA AATCAGTGAG CGATTTCCCT TGTGCAGGGA TGGGGGTTGT GGCTGGATGG
223021 ATGGTACTTA AGAAGTGCTC CTGGGGTACT AGAAATATTT TATTTCTTGA CTTGGATGTG
223081 TGTTTACTTT GTGAATATTG TACATTTATG ATTTGTGCAC GTTATGAAT GTAGAAAATA
223141 AAACAGAAAG CAAATTCAAA GTATCATCCT TTTGAGAGCT TCTGCTCTGA CTTCGTTTTG
223201 ACCAATGGAG CAGTTGGGAA GGGGTCTTGG TCCTTCGGTC CTTTGCTTTT TTTTTTTTTT
223261 TTTTTTTTTT TAGACAGAGT CTTACTCTGT CGCCCGGGCT GGAGTGCAGT GGCTCGATCT
223321 TAGCTCACTG AAAGCTTTGC CTCCCGGGTT CATGCCATTC TCCTGCCTCA GCCTCCCCAG
223381 TAGCTGGGAC TACAGGCACC TGCCACCATG CCCGGCTAAT TTTTTGTATT TTTAGTAGA
```

Figure 1

```
223441 GACGGGGTTT CACCATGTTA GCCAGGATGG TCTCGATCTC CTGACCTCGT GATCCGCCCA
223501 CCTGAGCCTC CCAAAGTGCT GGGATTACAG GTGTGAGCCA CCGCGCCCGG CCCCTGGTCC
223561 TCTGCTTTCA TGTTCTTCTT GGTCCTGTTC CTCCTCCTCT TTTGTTGGAA CTTCCAGTAT
223621 CAGAGCAGGA AGGAAGGCAA TGGGTCAATC GATGCTGTCA GCTTTTGGAT CAAACTGCAA
223681 GTTCTCAAAC AGCAAAATTA ATGAGCTCAG GCTTTGAAGA AACCATGACC CTGAAAGCAT
223741 CAGTTGCTTC CAATTGCATC AGTTGCCACG GGTGATAAGA ACAATGATGA CTCAGAATGC
223801 CTAGGTTTTC CCAGCAGCTT CTCTGAGGTT TTCCCAGCAG CTTCTCTGAT TGATTCCTGA
223861 CAGATGACTT CGGTGTGTCA GACTTTCAGG GTATCTTTCC TTATGTGATG GTTTGAGGAA
223921 GAGTTACCAT TCACATTCCT AATGGCTTCA GAATAGATGC AATTGTGAAC TGATAGGAAA
223981 CATTTCTAAT TCATCTCCCC TCCCCATCCC TAAAGGATTG TTTCTAACAA TAGTCATGAA
224041 AATTAATTCA CTTTTCTCAA ATAGTTTATT GTCATCTACC TAATGATGAG ATGACTTACT
224101 TTTTCTCCTT GACTGTTAAA TATTATGAAT TATATTAATG TATTTCTTAA TGTTGAGCTT
224161 TCCCTTGAAT ATTCTTTTGA TGTACGACAG AATTTGATTC ACTAATAGTT TATTTAGGAC
224221 TTTGCTGAT GTACTGATAT ATGAGATTGG CTCTGTATGC ATACATGTGT TTTGTGTATC
224281 TTTTTTGTGT CTGGATATGG AGCTTATGCT GATTTCAAAA ACAAGAAAGG AGAACTTTCC
224341 TTTTTCCCCA TTACTCTGAA AAAGATTGAC TAGAATGGAA TTTTTATAAT TGCTGTTGTT
224401 ATTTGAAAGC TTGAAAGCAT TGGTTTGTAA AAATCATGCA GGCTGAAAGC CATTTTGAGG
224461 AGACTTTGAT AACTTTCTCA ATTTCCTTCA GTTACTGGTC TTTTAAGGGG TTTTATATTT
224521 TTCTTTGATC AATTTTGACC ATTTATGTTA TCTTGGAGGA TCATCTATTT TACACACTAT
224581 TTAAAGTATA TTTGCAAAAA TTCAACTGTT TTATCAGGCT ATCTTTTTAA TAATATATTC
224641 ATTTTATCTA TATCTGAGGT TTTAGCTTCT TTGTACTTCT GACCCAATTG CATGTGTGCT
224701 TCTTTCTCC TTCATTAGAC TACTTAGTCA TTTACTAATT TTAAGAATAG CTTGTCTTTT
224761 ATTTATTTAC TTATTTATTT TTGAGACGGA GTCTCACTCT GTCACCCAGG CTGGAGTGCA
224821 GTGGCGCGAT CTCGGCTCAC TGCAACCTCC GCCTCCGGG TTCAAGTGAT TCTCCTGCCT
224881 CAGACTCCCG AGTAGCTGGG ATTACAGTCA TGCACCACCA TGTCTGGCTA ATTTCTGTAT
224941 TTTTAATAGA GATGGGGTTT TGCTATGTTG GCCAAGCTGG TCTCAAACTC CTGACCTTAG
225001 ATGATCTACC CACCTTGGCC TCCCAAAGTG CTGGGATTAC AGGCATGAGC CACTGCGCCC
225061 AGCCCTGCTT GTCTTTTTAT TTTATATTTG ATTAGCTTTA TCTTTTATCA AGCTTATGTC
225121 CTATTTCCCT TTGCTTTACT TCATATAAAT TTTGTTTTGG ATAGTTTATT TATTTTTCAT
225181 TTAATTATGA AACAGGTTAA AGCTTAGAGG AAAATTGCTC CTCTAAGTCC AATTTTGTGG
225241 GCAGATTACA TTTTGCTGTG TTGTGCTCCC AAATTCATTG TTCTTTTAAT GCTTATTTC
225301 TCAAGTTAAT AACCTATATA GTAAAAAGT GGCTGTTGAC TCTCAGCTTT TTTTTTTTTT
225361 TTTTTTTTT GTAGATACAG GGATCTTGCT GTGTTGCTCA GGCTGGTCTG AAACTGCTGG
225421 CTTCAAGGGA TCCTCCTGCC TTGGTCTCAC AAAATGCTGG GATGACAGAC ATGAGACACC
225481 ATGCCTAGCC ATGTCTCTCT CCTTATATAT AATAAGAAAA CAGACACACT GAGGCATCCT
225541 ATCATCTCAC TCTTGGTTTC ACTACTGTTC TCTGGAAGTT TTGCTCTGAC CTTTTGCAGT
225601 TAATGTATTA ATTTTGCATT GAGTAGTTTC CATAGAAGAA TTATAGCATT TGCATTCTGT
225661 TGGGTATTAT ACTTTTCACT GTTATTTGAA CATAATTTGA GGGCTGAAAC CAAGATGAGG
225721 CAAGTGAGGT GCCCAGGAAG CAATATTTAA GGAGGCATCC TTTCTTAGGC TCATGCAAGA
225781 ACAGAATTGG CACATGAGAG TGAGTGCCTC CTTAATTTTG AGTGCTGGAC ACTTCTTGCT
225841 CACTTAGCAT ACCCCTGGAC AATGAAGTGT TTTTGTTTT GTTTTTCAT GTCCATCCTT
225901 TATCCTTCTT CATCTCAAAA CATTTCAATG GAGTATTTTT TTGGAGCAGT ACTTGGATGA
225961 GCCTCTGAGT CCCACAGTAG CTGAGAATTT ATTTCATAGT ACTCTTATG ATCACTGTGG
226021 AGCCTTAAAA CATTGTAATA TTAACTTAGC TGGGAACAGA AATTTTGTTC CACAATTTGT
226081 CTTATTCAGA ACAGTATTGA CTTCCTGCTA GTCTCTTCTG ATGTCCAATA TGAGGAAGTC
226141 TAGTTAGCCA GCTACTTTTT GTAGGAGAGC TATGTTTAGG CTAGGTGCTA TAGGATTCTC
226201 TTTATCCTGG AATTCCTTCA CCAAGATGTG CCAAGGTGTT AATCATTTC TCTTGCTTTT
226261 TGGCTGGTGG TCTTAGAGTT TCCTTCGATT TTGTTTATT TAGTGATTGT CCTCAATTTG
226321 TTTTCTTTAC TAAGAATCTC TCTTCTATTT ATCTGTATGG TAAAACCTTG TTGCCCATCT
226381 TTCTGGTTTC TGCTGACTTT CATTTTTGGA CCTTTTACTT TGCTTTCTCC ATGGACTTTT
226441 TGGTAGTGGA GGCAGGCAAA CACTTTCCAA AGTCTTTCTC AATTTCCATC AATTTCAACT
226501 TATTTCCTAA AATTGCCTCA GAATGTGCCT ATGTCCACAA TATCCCTCCT TCCACTTTAG
226561 AAAGGAAAGG CATCCACACT TTATTTAGGT GCAATGCCTG AAGTGTAAAC ACTTTCTGGT
226621 TGTCAACAAA GGAGTACTTC CAAATATTGG TTTGGGGATA ACCTGCTAAT GATTAACACA
```

```
226681 TTCACCTTGG CTCTTGGTTT GCCTGCTCCC TCTTCTTTTA TCTGCTGTGT GTATTTTTTT
226741 TAATCACTGA GAATATGCAC AGTATTGTAT GTTTTATTAT AAGAGAGGAC TGGCCAGAGT
226801 GGGAATGTTC TGAATTCAGA ATAACTGAAG CAGTACAGGA TAGGAACTCA TTCTTTCAAA
226861 TGAAGCTGGC ATATTTCCC AGAGCACCAA ATTTCAATAT ATATTAAAA AACTTGATAT
226921 GAATGATACA ATAAAGTGGT TAGAACTTTT ATTAAAATAA ACTTATGTCA TGAAATACTT
226981 ATTCTAATTA TAGTCACTCT TCATCTTATT TCATCTTATA ACATGTTTAA TGTTTTCTTT
227041 TATTTACAAA ACAATTTATT TTTTGATGAA AAGTTTTAGA AATCAAGTTA AAAATATTCA
227101 AAGGAATGCC TAAAGTTTTC AAAATTCTTT TACATGTTGT ACAATCAAAA GAGTCTGAAG
227161 ACCATTTAGC TATCCAAATT GTTTATTTTT AAGCAGTATC CCTTCTAATA TTTACTATTT
227221 ATAATCCTTA AAAATTTGCC TTAGCACAGG AGAATTGCTT GAACCCAGGA GACGGAGGTT
227281 GCAGTGAGCC AACACAGTGC CACTGCCCTC CAGCCTCGGC GACAGAGTGA GACTCTGTCT
227341 CAAAAAAAAA AAAAAAAAAA AAAAAAAAAG GCCAAAAACA AATAAACAAA CAAAAAAATC
227401 CGCCTTAACA TTATTTGTTC ATTAAAAACT TTCTTTAATA CTACTAGTTT CCCTTTCCTC
227461 TCAGCCCATT GTCATATTTT GATTTTTATC ACTTGCTTTG TAGGACATAT GAGGTTTTTG
227521 TTTTTTTTTT TTTTGGAGA TGCAGTCTCC CTCTGTTGCC CGTGCTGGAG TGCAATGGCG
227581 CAATCTTGGC TCACTGCAAC CTCTGCCTCC TGGGTTCAAG CAATTCTCCT GCCTCAGCCT
227641 TCCAAGTAGC TGGGATTACA GGCACCCACT ACCACGCCTG GCTAATTTTT GTATTTCTGG
227701 TAGAGACGGG GTTTCACCAT GTTGGCCAGG CTGGTCTCGA ACTCCTGACC TCAAGTGATC
227761 CACAATCCTT GGCCTCCCAA AGTGCTATGA TTACAAGCAT GAGCCACCTG CCCAGCCAGA
227821 ATATATGTTC ATTTTGAGTC CTTTAACAAA GTCATAAGAA TTTTAGGAAT TCAGTTACTT
227881 TCTTGAGAAA ATCTCTGAAA AGATGCCAAT AATTTGTAGC CAATTATATT GATTTCTCTT
227941 TTTCATATTG AGAATTGTTT TTTAAAAAGT TTGTATGTGT GAAGATTTTT GCACTGTAGT
228001 TAAAGAAACC ACCTGTGTGT TGGTTAAGCC ATAAGTACAT GTATTCAAAT AAATTGAGGT
228061 GGGGTTACTC TGAGAATCAA AGGAAAACCT GAAGAAACAG GCAGCCTCAA AAGGTCTTAG
228121 CTGTAGCAAC TTGCTCCATT GTTGAAATAA ATAGGCTTGA ACTTGTATTT TCCCTCTACT
228181 CAACATTTAA GGTCTCAGAA GATAATATAA TTGGTGAAAT TTAAGTAAAG TGCTCACTCT
228241 TTTGCTTTAA CAAACCCTAG AGAGCTGGTA GGCAGAGCCT CAACAGACCG TTTTAGCTTC
228301 CAAAGGGAGT TCAGGACACC ATGATTCACG ACCACAATAC ATCACACATA ATTGAGAAAA
228361 GATAGTTCCA CCAAATAAAG TTGAAATGCT GACAAGAAGG GGTAAGAAAT CTTGGAAATA
228421 AGTTTATATA AAATTTATTT TTTCCTTTTT TATTGTTATG GAATAGGACC AGTTCTACTT
228481 AAGCCACCCA TTTGCCAAAA TAAAGTGAGA ATCGTTTCTT TTGGGGACTC CTCTTTGTAG
228541 CTCCAAGTGC CACTAACAAT TCTTAGGACC TGAGCTATAA GCCAGGTGAT TTCAGTTAAT
228601 ATGATCAATT ATTTCATTTA AATGGCTCTA ATGTGCAGAG GGAACGGAGC CCATCAGCAT
228661 TCCCTGCAGG GAACTGCAGT GGCTTTTATC AACTTGAACA GCTAGCTTTC AACTGTTTTG
228721 AAATCACTTT CAGGGTGGTC ATGTAGTTGC TTTTTTGAAA TCAGAAGATG ATTCTGCCTC
228781 TTTTAATATG TGACTCCTCA GATTCAGAAA GTGCTCGCTA GTCTTAAGAG TGAATTACCC
228841 TCAGTGGTCC AGCGCTTATG AACCCACATC TAACCCTATC CCCTGGGGA ACTATCAGAG
228901 AAATTGGTGC CATGGACATA AGAGGAAGC ACAGTGAAGC AGAGAGCCCC GCATGATGAA
228961 AATCAGTGGA CAGCATCATT ATTTACAACT TTGTAATCAC CCAGGAGCAT GAAAATCCAG
229021 GCCAATCTGG CACCATGAGC TCTAATTTTT GTTGGAGTTC TTGGAACCGA TTCTGATGAA
229081 TGACTGTTTA GCCATTTTAG AGTGTGGCAT ACGTGGCTGC TGGCATACAG AGGTTGGATG
229141 TAAACGGGCC TTTGCCCTCT CTTATGAACA TAGACAGGAA CTAAACTGTG TCACATAGGT
229201 TCCAAATGGT GGCCTGAATA CTATTTACAA CTAAGGTACA ATGAAATTGA GTAAGTCTTT
229261 TCCTCTTTTG CAGATACCAT CATTATTCAT ATATTTCTTC AAAGTTAACT ATTTGTATTT
229321 GGTAATTTTT AATAGAAATG TAATAATTGC TTCTCAAGTT TAGTCTTTAG TCTTAAGGTT
229381 GATGCTCTCC ATGTCCTTCC AAAAAAGGT ATGTTGCTTT TATTATATCC TCGCCTTCAG
229441 ATGGGATTAT TCCATTTTGT TCTTTGTTAA TATATACTTT GAGCCACTTT TTTTGTGGCT
229501 CTGGGTGAGA TGCTATAGGT ACAATGACAA GTGATACGTG TGTTGTCCCT GTCACAAAAG
229561 TGGATAGCCT AAGTGGTGAC TTTTACCTCC ACTCCAAATA TATGTATCAC ACACCAGCCG
229621 TATGCCAGGC ACCACTCTAG GTGCTAGGGA TACAGCAGTA AACAGACAAA TGCAACCCCT
229681 GCCCATGTGA AAGAGAATAA GACAATAAAT AAGTAAAGTG CATGTTATAT GGAGGTGGCA
229741 AATGCTAAAA AGAAAAATTA AGCAGGCAAG AGGACTCATT GAAAAGATGA CATTTGGGTA
229801 AAAGCCCATG TATATATGTT CTATTGGTTT TATTTCTCTG GAGAGCCCTG ACTAATACAC
229861 AATGACTTTG AGAAGTTACT GGCTTTTGAT TTATCACACT ATTCGGAGTG CTGAGAGCCT
```

Figure 1 (Page 71 of 73)

```
229921  TCTTAGTGTG TATTCAGTGT TTTAAGAGAG CTTGTGGATG AATAATAAAT AGGACAAAAT
229981  TTATCCAAAC TTAAGCCTTG CTTTAGGTAA AAGGGCTCCT CTTACAAGGT AGAAGGTTAT
230041  TATTTGGCAT TTAAATCCAA CTGAAGACTA ATAAGACTAA TTAATTAAAA GTTTTTAAAT
230101  CACAACTGGG TGCAAAATAA ATGGAACTGC CATGCTCGCC AAGTGTGCAT GAGTGGTGTG
230161  CATGGGAGAC AGCACGAAGC TAATCCCACT CATCTTGCAG GTTGCTCCAT TTTTCTCCTA
230221  AAATCAGTAA GACAGAAGCT GGTCAGATTA TCAAGAGCCC TAGTTAAACA CAGCAGTAGC
230281  ATTTGGAAGG GGTTGCTCTC ATTAGGCAGT GCCTGACCAC AACAAGAGAT GAACAAGCCC
230341  TGTATCTGAA GCCATCATGC CTAGTTATGG TCCCCACTG TTCATGATGC CTGAAAGGGA
230401  GGCCCCTGC ACCCTAGAAA GCTGGGTGGG TTCTACTGTC TGCTTTACTG CTAAAAACCC
230461  TCTTCTTTGG ATCTGGACTT TACCTCTATC TGATTTTTTT TTCTAATATA TGATTTGGCA
230521  CTGAGTCTGT CACTGCTGCT AACTCAGCAG TTCTAGGGTC ATTGCCCCAT TGCCTCACAG
230581  AAAGAATTTC ATAGCTTCCA GCATCCTCTC TCCTTCATTA TACTTTGATT TCAGCATTGC
230641  TATTTTTTCT CTTGGGTGTT GCAGCTCTCT CTCTCCTTCC CATGTCTTGT TGGTTTTCTG
230701  CTAACTCCTG CTTTTTTTCT TTTTTTTTTT TTGAGACGGA GTCTCGTTCT GTCACCCAGG
230761  CTGGAGTGCA GTGGCACAAT CTCGGCTCAC TGCAACCTCC GCCTCCGGG TTCAAGCTAT
230821  TCTCCTGCCT CAGCCTCCCA AGTAGCTGGG ACTACAGGCG CTCACCACTA TGCCCCACTA
230881  ATTTTTGTAT TTTTAGTATT GCTGTCATCA ATCCACATGT CCAGAAGCAC CTAGAAACTC
230941  TAATTCTTTG TAGGTATCAA ACCCTAGGAC TCTTTCCTCT AATCACAATA TATAATCCCT
231001  GATTCCCAAA CACGGTCTTT TCATATACAT TTTCCACTGT ACATACTTTC TGACCTGGAA
231061  AGCTCTTACA CAAACACGCC CTCCCCTAGG AAGCCTTTAT AAATGTTCCC AGGAAGAATC
231121  AGTCACCCAA CAGTGTCCTT GTCACATCTT AGGTTCTACA CCTTTATTTG TTCTATCTGA
231181  ATGTAATCTC CCAGAGGGTG TTATCATCTT TTTTTTGAG ATGGAATCTT GCTTTGCTGC
231241  CCAGGCTGGA GTGCAGTGGC ATGATCTCGG CTCACAGCAA CCTCCACCTC CTGGGTTCAA
231301  GTGATTCTCC TGCCTCAGCC TCCTGAGTAG CTGGGATTAC AGACGTGTGT CACCACACCT
231361  GGCTAATTTT TGTATTTTTA GTAGAGACAG GGTTTCACCG TGTTGGCAAG CTTTCCTCG
231421  AACTCCCAAA CTCAGGTGAT CCACCCGCCT CAGCCTCCCA AAGTGCTGGG ATTACAGGTG
231481  TGAGCCACCA TGTCCAGCCC CATCTTTTC TTTTAGTTTA GTTCTTAACA AATAGTCTGA
231541  CACAAAGTGG ATATAACAAT ATTTTGAATT ATGAATAACT AAATGAATAT TTCCAGATTT
231601  CCTGGTGCTC TCAAAGTTTT ATGTTACAAA AGAAAAACAA GTCTAAAATA CCTGCCTCAA
231661  GTTTTTATCT GTACTATGAT TTCAAACCAA ATAAAAAACA GGTGGGGTAA AAACTGAAAC
231721  AGGAAATACA TATAACTGAA AAATTTGGT ATGTTAGTAT GATAATACTA GGTCATTTTT
231781  CCTGTTTCCC CAACTTCATT TTCTATAGCA ATAAAAAGAA ACAAGTAAAT GTATATTAAT
231841  TTAATTTAAA AGAAGTAGTC TACCATCTCT TCTGTTAAAA AGAAAAAAGT ATTTTAAAAA
231901  ATTATCTCTG GAAGGATACA CAGGGAACAT TGCTCTGGTT TCTTCCAAGA GAGAAATGAG
231961  GAACTAGAGA GCATGGCCAA GTGGGGTTTT GCTTTTGTTT TTGTTTGTCT ATCTGTTAGC
232021  TTTTTATTAT TTTCTTTTGT AGGTTTGAAT TCAAACCAC ATAAATCTGT TACATGCTCA
232081  TAATAATAAG TTTAAAATAA AACTTTTGGC TGGGTGCAAT GACTTACACC TGTAATCCCA
232141  GCGCTTTGGG AAGCAGAGGT GGGAGGATAC TTGAGGCCAG GAATTTGAGA TCAGCCTGGG
232201  CAACATAGTG AGACCCTGCC TCTGTAGAAA TAAACAAAAA TTAGCTGGAT ATGGTGGTGC
232261  ATGCTTGTAC TCCTAGCTAC TTGGGAGGTT GAGGCAGGAG GATCCTTTGA GTCCAGGAGT
232321  TTGAGGCTGC AGTGAGCTAT AATCACCCAC TGCACTATAG CATGGGCAAT AAGGTGAGAA
232381  CTTGTCTCAA AAAAAAAAAA AGGGGGGGGG AAACAAATAA ATAAATATAA ACAAAACTTT
232441  TGTTTCAAAA TATGTAATAT TTAGCACTAA AGAATTCTGA ATTGTAGAGC TAAAAAGTAC
232501  TTAAAAGTTA ATAATTATTG TCTCCTTTAA AAGAATTGTT ATCAAAGTAT AATTTTTATC
232561  CAGAAAATCA TCCATATCAG CAAGCTAAAC TTTCTCAAAA TGACATATCC ATGTAATTAG
232621  CTCCCAGGTA ATTAGCAGGC AGCCTCTACT CAGGTTGAGT ATTCCTAATC TAAAAATTGG
232681  AAATTCAAAA TGCTCCAAAA TCGGCAACTT TTTGAATGCT AACATGATTC TCAAAGGAGT
232741  GCTCATGGAA TATTTCAGAT TTTGGATTTT TGGATTGAG ATACTCAGTA TAATGCAAAC
232801  ATTCCAAATC TGAAAAAATC TGAAATACTT CTGGTTCTAA GCATAAGGGA TACTCAACGT
232861  GTGTTAGCTA ATTAGACCCT TCATGGTCTC TTCTAGACCT CAGCTTCTTC AAGGTAACCT
232921  CTATCCTCAC TTCTAATAGC ATGAACTTTT CTGTTTTAGA ATAATTTGGA TTTTCAGGAA
232981  AGTTGCAAAG ATAGTACAAA GACAGTACAG GAGAGTTCCC ATATATCTTT CACCTAGCTT
233041  TCCCCATTG TTAGGATTTT ACATTATTAT GATACATTTG TCAAATATAA GCAACTCACA
233101  TTGATACATG AAACTCTATT AACCAAACCC TAGACTTTAT GTGGATTTCA CCACTGTTTC
```

```
233161 CACTAATGTT TTCTTTCTGT TCCAAGGTCC AATCTGGAAT ACCACACTGC ATTTTCTTGT
233221 CATATCTCCC TAGTCTTTTT TTGTCTGTGA CAATGTCTCA GTCTTTTCTT GCTTTTCATG
233281 ACCTTAACAG TCCTGAAGAT CATTTGCTTT TTTTTCATAA TTACACCGGA GTTATAGATT
233341 TTTTGAAATA ATACCACAAG GGCAAAGGGC CCTTCTTGTC ACATCATTTT AGGGAGAACA
233401 TGATATCCAC ATGACATCAC TGATATTAAC CTTCATCATG TGGTTTAGGT AATGTTTCAG
233461 GTTTCTCTAC TGCAAAGTGA TTTTTTTCCC TTAATTTAGC CCACCTGAAC TTATCAATTT
233521 TGTTTTCTTC CATGACTAAT ACTTTTGTTA TTATAGCTAA AACTTCATTG GGGCCAAATC
233581 TTAGATCATG TAAATTTTCT TCTATATTTT ATTCTAAAAG CTTGTAATGT TTGATACATT
233641 CTAAAAGATG TAATGTTTGA TACATTACAT CTAGTCCTTT GATTTATTTT TAGTTACTTT
233701 TGTATAAGGT GTGAGAGATG TCTCCAGTTT CACTTTATTA ACACATTGTG GTGTTCCAGT
233761 ACTATTTGTT GCTAAGACTA TCTTTTTTCC ATTGATTACC TTTGCCTTAG TTGGCAATAT
233821 TTTTGTTGGT TTATTTCTAG ACTGTTTATC TCATTCCACT GATTTGTGTC TATCTTTTTG
233881 ACAAAACTGT TGATTACAGT AAGCTTTGAA ATAGTTCATT TTTTGTGTCA ACTTGACTGA
233941 GTCAGGGGAT AACCAGCTAT CTGGTTAAAC ATTATTTCTG GCTGTGTTTG TGAGCGTGTT
234001 TCTGGATGAG ATTAGCCTTT GAATAGGTGA TCCTAGTAAA GTAAACTGTC TTTCCCAGTG
234061 TGGATGGCAT TATGCCACCT GATATTCAGG GTCTGAATAG AAGAAAGGC AGAGGAAGGG
234121 GGAATTTGGG CCTTTTTTTC TGCCTCACTG CTTGAGCTGG ACATCTCAT CTGGTCTCCT
234181 GCTCTTGAAC TGGGATTTAC ATCATCAGTT CCTCTGGTTC TCAGGCCTTC AGATTCAGAC
234241 TGAATCATAC CACCAGCTTT CCTGGGTCTC CAGCTTGCAG ATTACAGATC ATGGGACTCC
234301 TCATCTTCCA TAAATGCATG AGCCAATTCA GTCTATGTCC TTGAAAACTG CGCCACTGCA
234361 GATTAAGGCT TTTTTCCACT AGGTGAAATA AAGAAGCTTG TTAGACAGAT TTCCCTTCAT
234421 CCAGTGCCCT CTCCTCTTTA AGTTACAACA CATTGGCTAC ACCTAAGTGC AGGGGTGGGG
234481 ATGAGGGTAT AGTCCTCTTG TTTGCTGAGA AGAGAACTGT ATTGGGAAAG CTCTAGAAGT
234541 GTTTGATACA TACATAAACA AGGCATGGTT TTTGCACTTA ATTTCACATT ACATTTTTCC
234601 CAGAAAAAAA GGAATGTATA GGCATACGT AACTGTACTA GCTGGAGTCA TTCTTCCTGA
234661 TTATCAAAGG TAAACAGTTA TTAATCCTAT ACCAAGATGT CAAGGAGAAG TACTTTTGGA
234721 ACACAAGGAA TTCTCTGGGA GTCCTTACTA CTCTCAAGCC CAGTGAAAAA GTTAATGAAA
234781 AACTATAGTA CCTTCCTATA AGCTGGATGA CTAATTACCA GGCTCATTTA GGAATTTGCC
234841 TTACCAAGTA AAACATAAGG GCAGCTGAGG TGCTGACTGA AGACAAATGG AGCATAGAAT
234901 AAGAGTAGTA AAGAATGCCA AAAATGCTGT CATGTATCCA TTGACAAAAG GAGCTATAAA
234961 GCCTTTAGGT ATTTTCACAC TTGCTCTGTT ACGTAAATGT ATGTGTGTGT GTGTGTGTGT
235021 GTGTGTGTGT GTG
//
```

Figure 1 (Page 73 of 73)

```
   1 CACACACACA CACACACACA CACACACACA CACAAATGAG GTATATAAAG GGTCTCCTAA
  61 AATGTCATCT GATATTTGTT ATTTCATATT CTCAGATTTT TAATCCATTT AGGTAGGTCT
 121 ATTTTAGATA GCCTTGTCTG AAACAGAGCT GGGACCTGAT GAGTGAAAAT GAGCTCACCA
 181 GAAGAAAAAT CAAACAGGCA TTTCAGAGAT TGAGGCCAAG AAGTTAAATG TCTTAAATGG
 241 GCAGAGCTTA GCTGCTTGAT GTGAAAAGAG ACCAGCGTGG CTGGAACAGC AAAGGAGAAC
 301 AGCAGAAGAG GTGAACAGAG GCCAGAGATG GTCACTGAGT GGGCCCTTAA GTCATGGTAA
 361 GGAGTATGGA GAATGAATTA TTGCATGTAT TGAATATGTA GGTGACGTGA CTCACAGATA
 421 CTTTGGATTT GTAGAGATGA AGGAAATGTA GCAAGTGACA CTCTTAGAAT GTTGATTTGA
 481 GTAAATGGTA GTGTCAGTTA TTGAACTGGG GAGAACTGGA AGGGATAACA GGCTTAAGGA
 541 GCACGTTTAT TCCTGTGTCT TGGAAGTGTT TAGGGTGAAA GACCTATTAG AGTTCTAAAT
 601 GGAGATGTCA AGTGAAAATG TGGCTACACA CATTTGCATT TCAGAAAAAA GGTCAGGCTG
 661 GAGATGTAAA ATTGGAAGTT TACTGCATAT AGATAGTCTT TGGAACCGTA GTATTGATGA
 721 AGCCATTAAT GAGACAGAAC AAAGACTAGG GACCAGAGCC AAGCTCCAAG TTTCTAAAAT
 781 TTAGAGGATA GTATAGTCTG GTCATTTTGA GGTGAATACT TAATAACAGA ACAATTTGCT
 841 GAAGTGTAAA TTTAGAGCCC TACACTTTTA GCTCTGACTA TTAACGAATA CAGGAAAGAA
 901 TGGATATGGT TATCTGCCTG GTGTCTGTGA AATAATTTAA GCCAGGAAGA GATCCTCACC
 961 AGAAACTGAC TATGCTGGCA ACTTGGATCT TAGATTTCCA GCCTGCAGAA TTGTTAGAAA
1021 ATAAATGTCT ATCGTTTAAG CCACCAGTCT GTAGTATTTT GTTATGGCAG TCCAAGCTGA
1081 CTAAGTTTTG GTACCCAGGC GTGGGATGCT GCAACAACAA ATACCTAAAC ATGGGGAAGT
1141 GGCTTTGGAA ATTGGTGATG GGTAAAGGCT GGAAGAGTTT GAGGTTCATA CTAGAAAAAG
1201 CCAATTGTGA AGGGACTATT GAAAGAAATA TGGACATTAA AGGCAATTCT GGCAAAGGCT
1261 CAGAAAGGAA GAGAGCTGGA CAGAAAGCTT CCATTTCAT AGAAACTTAG ATTTATAACG
1321 ATCATGGATA GAATATTAAA TATGCTGGTT AAAATATGGA CTTTAGGCCA GGCGTGGTGG
1381 CTCACGCCTG TAATCTCAGC ACTTTGGGAG GCTGAGGGCA CAGATCACGA GGTCGGGAGT
1441 TTGAGACCAG CCTGGCCAAT ATGGCGAAAC CCTGTCTCTA CTAAAAATAC AAAAATTAGC
1501 TGGGCATGGT GATGTGCTTC TGTGGTCCCA GCTACTCGGG AGGCTGAGGC TGAAGAATCG
1561 CTTAAACCCG GGGGGTGGAG GTTGCAGTGA CCCAAGATCA CACCACTGCA CTCCAGCCTG
1621 GGATACAGAG CAGGACTCCA CTCCCCCCGC CACACACACA CAAAAAATAT ATATATATGG
1681 ACATTAAAGT CAACTCTTGT GAGGTCTCAG ATGAAAATGA GGGACAGGTT ATTGGAAACT
1741 GTAGAAATCA CTGTTCTTGT TACAATGTGT CAAGAACTTG GCTGAATTAC GCTGTAGTGT
1801 TTACTGGAAA GAACTTATAA GCAGTAAAAC TGGATATTTA CCAGAAGAGA TGTCTAAGCA
1861 AAGTATTGAA GGTGTGATTT AGGTCCTCCT TACTGCTTAA AGTGAAATGT GAGAGGAAAG
1921 AGCCGAAATA AAGAAGGAAT TTTAAGCAA AACACAATCA GAACTTGGAG ATTTGGGATA
1981 GATTTCTCAA TCTATATTGT AAAAATTGAG AAAGTTTTC TTGAAGAGGT ATGGTTGAAC
2041 AATGTTTTCT TTTTCTTTTT TTTTCTTGGT TTTATTTTA TTTTTATGTT TTTTGAGACA
2101 GGGTCTGGCT ATGTCATCCA GGCTGGAGTG CAGTGGCACA ATCTCAGTTC AGTGCAACCT
2161 TTGCCTTCAG GCTCAAGCAA TCCTCCCACC TCAGCCTCCT AAGTAGCTGG GACTACATGT
2221 ATGCACCACC ACACCCTGGC TAATTTTTTG TTGTTGTTTA TAGAGATGGG GTTTTGACAT
2281 GTTGCCTAGG CTGGTCTCTA ACTCCTGAGC TCAAGTGATC TGCCCTCCTC AGTCTCCCAA
2341 AGTGTTGGGA TTACAGGCGT GAAACACTGA GCCTAGCCTG AACAACCATT TGATAAAGAG
2401 ATAATGGGTG TGACCCAAGG ATTTAATCAG CCATCTCAGC AGAAGCCAGG AAGAGAGATG
2461 GGATTATTCC AGCAGAGACA CTGCCAATTT AAACTAACGT AGGCAGAGAA AACAGAAAGG
2521 AACAAAGGAA GGTTGTCGAC TTTTTGAATT CTATAGAACA GGATCATAGA GCTACCTGGC
2581 TGTCAATGTG TACTATTCTT TAAGAAAAGG AAAGACTGAC CCACCAAAGG CAACTTACAA
2641 GATCACTAGG GCTGACTCTT TTTTGTTTTT TCTTGAGGCA GTCTCACTGT CACCCAGGCT
2701 GTAGGGCAAT GGTGTGATCT CAGCTCACTG CAATCTCCAC CTCCCAGGTT CAAGGGATTC
2761 TCTTGCCTTA GACTCCCAAG TAGCTGGGAT TACAGGCTCT AAATCTGTAC CCTCCCGAGT
2821 AGCGCTCCTG CCACCACTTG CCCAGCTAAT TTTTGTATTT TTAGTAGAGA TGGGGTTTCA
2881 CTATGTTGGC CAGGCTAGTT TGGAACTCCT GACCTCCAGT GATCCATTCT CATTGGCCTC
2941 CCAAAGTGCT GGGATTACAG GCAGGAGCCG CCAGGGCTGC CACTTTGATG TCAGACTCAG
3001 AGAGTACAGA TGGGATAGGG TGGGGTGGG AACATGTAGT CAAGGCTGAC TCTACCTGTT
3061 TCAAGATGCC CCTGCAGAAC TGTGTGGGAG TCTCTCACAG ATGGCTGCCT GGGTGGGACC
```

```
3121 CCACCAAACT GAAAGACCGA GACTTCAGGC AGGGCAGATG GAGTAGGCCA ACTACAGAGC
3181 CAGAGGTGAC ACTGAGACAC CACTGGGCCT GGAAATCAGG GCATCAAGCC AAAGAGGGTT
3241 TTTCTTAAGA CCTAACAGAA TTTGCCTTGC CAGGTTTTGG ACTTGATTAG GACACATTAC
3301 ACCTTCCTTC TTTCCTATTT CTCCATTTTC TAATGGGAAT GTCTATTATG CCTGTTTCAC
3361 CATTGTACCT TAGAAGCATG TAACATTTCT GGTTTCACAC GTTCAAAGCT GGAAAGGAAT
3421 TTTGTCTCTG GATGAATCAC ACATTGAGCC TCACCCGTAA CCTGATTTAG ATGATTTTTT
3481 AGATGACACT TTGAACTTTA GAATTGATGC TAGAATGAGT TAAGACTTTC AGGGGGCTGT
3541 TGGGATGGAA TAATTTTTTT TTTTTTTTG AGACGGAGTC TAGCTCTGTC GCCCAGGCTG
3601 GAGTGCAGTG GCACCATCTT GGCTCACTGC AAGCTCTGCC TCCCGGGTTT ATGCCATTCT
3661 CATGTCTCAG CCTCCAGAGT AGCTGGGACT ACAGGCGCCC GCCACCACGC CTGGCTAATT
3721 TTTTTTTTAT TTTAGTAGAG ATGGGGTTTC ACCGTGTTAG CCAGAACGGT CTCGATCTCT
3781 TGACCTTCTG ATCCGCCTGC CTTGGCTTCC CAAAGTGCTG GGATTACAGG TGTGAGCCAC
3841 CATGCCCGGC TGGGATGGAA TAAATTTATC TTGTATGGGA GAAGGACATA CATTTTGGCA
3901 GGTCAAGGAC AGAATGTTAT GGACTAAACT GTGTCCCCCA AAATTCATTT ATTAAAACCC
3961 TAAACCCCAG TGTGACTGCA TTTGGACATA GAGCCTTTAG GGGGTACATA AAACTAAAGA
4021 TCACAGGATA GGGCCCTAAT CCCATTGGGG CTGGTGTCCT TACAGAAGAT GAGACACTTA
4081 GAGCTCTCTC TCCACGCAGG CACCAAGGAA ACACCATACA AACACACAGT GAGATGGCAG
4141 CCATCTGTTA GCCAGGAACA GATTCTCACC ATAAACTATG TTGGCACCTT GATCTTAAAC
4201 TTCCAGGCTC CAAAACTGTG AGAAAATGAA TTTCTGTTCC AAGCCTCTTA GATATGGAAA
4261 AAAAGATTCT GTTGTTTAAG CCATCCAGTC TCTGGTATTT TGTTATGGCA GCCTGAGTAG
4321 GCTAAGACAA TGAAGGATGT GGTAAAACTT TACGTCCCAA CCACATACCA AAGAGGCTGG
4381 AATTTAGCAT GCTTTCTTCT TTCAACTGTA GGCAATGTGC ACAAGTTCTA AATCCTAAGA
4441 CATGTTGGCT CCTTTACTCT GCCCAAACTA CAACTCAAAC AAACAACTGT AATATAATAA
4501 CATCCAATGA AGTTCTGACA TTTCTTCAAC ATGAGTACAG TAATTCAATG CCAGAGAATT
4561 CATTTTATTT TGAAATCTAC ATGCCATATT CCAATTTCTG TTGAAGATGC AATGGTTATA
4621 TTTATTCTTT TTAATATAGA TTTATCAGAC TGGGCGCGGT GGCTCATACC TGTAATCCTA
4681 GCATTTGAGA GGCTGAGGTG GGCATATCAC CTGAGGTCAG GAGTTTGAGA CCAGGCTGGC
4741 CAACATGGTG AAACCCTGTC TCTACTATAA ATATAAAAAT TAGCTGGGTG TGGTGGTGCA
4801 TGCCTGTAGT CCCAGTTACT AGGGAGGCTG AGGTAGAATT GCTTGAACCT GGGAGCAGGA
4861 GGTTGCAATG AGTGGAAATC GCACCAGTAC ACTCCAGCCT GGATGACAGA GCAAAATAAT
4921 AAATACATAA AATAGATTTA TCAGTTTATC AATAATATAG TTTTCTTTTC TAGGTGTAAA
4981 TATAGGTAAT GACTGTCCTT TAGTACATTT TCTCATGATG CTCCTCTTAC TTGGTTTGGT
5041 ACAATATTAA GTATTGAAAT AAAATAGAGA ATCCTGTCGC TACACATGAG CACTTATTCC
5101 ATTTGCTCAT CTCCAATATG CACGGGAAAT TCTCAAATTG CTAATAATCT TGTAACACAC
5161 ATGCATTATA TTCAACAGGA ATATATAAAT TTATAATTAT AATTTAGGAT CAACAGATGA
5221 CAAACCTTTA GAAGGTTTGT ATTTAACCTT AAAATATAAT TTTTTAAAAA TTGGTTATAA
5281 AATTTCTAAT ACTTTCTTTT TTGTGACCTC AAGGGGAAAA TATAATTCTT ATAAAAGTTC
5341 AAATGATTTA CAGAATACAA AAAGTGAATA GAGATGATGA ATGAATTAAA GGAAAGGATA
5401 TTGCTACATA GATTTGGAAA TTTAAAAAGG GAAATTACGA TTGTTGATTT TGTGTTAAAC
5461 TGATCTGCTT TGTTCAAGAT ACCTTATGTA CCAAAAAATG ATTTTATCTC AGCCTCATAT
5521 CTCAGTAAAT TCCTGAGACA AACTTTAGTC CCTGGTGCCC AGGTGCCTTT GGTAATTGGG
5581 AGACCTCTAG GTTTAGCATC CTCATCCACT CGCCCCAATT TAAATAGTCC TCCCCAGGGC
5641 CATTCAGGCA AGGGAGATGA AAACTTGCTC AAGAGTTGGA ATCCAATTGA AGCTACCGAA
5701 ATTCATTGCT CAATAGATAA TTTTCCCTGG AAGTAACTAG GGCTTTTGAA TATAATAGTG
5761 GGCATTTCAA AGTAGAAGGT AAAGTATTTT GGAGATGAGG AGACAGGACA GAGCTACGAG
5821 GAATGTCCTT TGCTCAGGGA CTAGGCTCTT AGCAGTACCT CTTAGGTAAG AACTGGTTAA
5881 CTGGCACCTT CTGTGTTTCT CTGAAGCTCC CTTTGCTTAG GGACTAGGCT CTTAGCAGTA
5941 CCTCTTAGGT AAGAACTGGT TAACTGACAC CTTCTATGTG TCTGAAGCTC CCAGAACAAA
6001 CTGCCAATGA AATTTGGATT TTTGGAATAT AGTTTCTTTT TTGTTGTTAC TTTTTGTTTT
6061 GTTGTTTTTT TTTGAGAGTC TCACTCTCAC TGCAACCTCC CCTCCTATA TTCAAGTGAT
6121 TCTCTTGCCT CAGCCTCCCG AGTAGCTGGG ACTACAGGCG TGCACTAGCA TGCCCAGCTA
6181 ATTTTGTAT TTTTTAGTAG AGATGGGGTT GGTTTTTTTT TGAGACAGAG TTTCACTTTG
6241 TCGCCCAGGC TGGAGTGCAG TGGCACGATC TTGGCTCACT ACAACCTCCA CCTCCCGGG
6301 TTCAAGTGAT TCTTCTGCCT CAGTCTCCTG AGTAGCTGGG ACTACAGGCG CCTACAGGTG
```

```
6361 AACACCGCCA CACCTGACTA ATTTGTGTAG TTTTATTAGA GATGGGGTTT CGCCATGTTG
6421 GCCAGGCTGG TCTCAAACTC CTGACCTCAG GTGATCTACC CACCTCAGCC TCCCCAAGTG
6481 CTGGGATTAC AGATGTGAGA CACCAGATCA GCCTCAGAAG ACATTTTCTA TTGGAAAGAG
6541 AAAACACTAT TAGCAACCTA TTAGTCTAAT ATTTAATACT TAATGTCTTC CTTAGTAATA
6601 AACCAACTCT CTACAACAAA GTGCTTCCTG GCTGCCTAGT CATTGATTCA TTCAGTTCAA
6661 CATTTTCTCA ATGCCCAACA GCCAAGTGTC TCCTGTATGC CAAGTTCTAT GCTGATTATC
6721 AGTATTTGAA TAAGAGGGGG TCTACATCTT AAGTACTGCT TAAGATGAAA GCCTCTAGGT
6781 TAACAAACTT AACACAATGT ATCATTCACT ACTAAATAGA CCGAATACAA AATCTTGTTA
6841 TTGGAGCCCA GAGAGAAGAA TTGAAATTCA AGTTTTCTCT CTCTCCTTTT CTCACTCACC
6901 ACAATAAGTC AGTTGCACCA AGTCTTGTAG CTCTTTACTG AGCCATGTTT TCACGTGTCC
6961 CTTTGTTTTA TTTGCCACAC CCTAAATAAA AATTGTACTG GCTTTTTTTC CCTGGGTTTA
7021 CAGTATTAAT ACATTGTCAA GATTTACCTC TTCGTGTAGA TTCCCTGGGG AAAATTACCT
7081 TTCCTCCTTC CCTTAAATTC TTCAGAGGTT AGAAAGCCAT TAGTAACATT CTGGTATGTG
7141 GACAAAGTTT ACCCATTATG TATGGATGTT TTACTCTTTC CATTTTTCTG ACAATAATCT
7201 CTTAAGGAGG TGTGGTTATA GAATAGTCAG CTGTTATAAG TACTGTTTTC CTGGCCTTAC
7261 AACTTAAATT CTTTAAGCTG TTTCTTAGTT TGCTCATCTC AAAATTCGGA ATAAGGATAA
7321 AACCTATCTC TTAGATTGTT GGATTAAATG AATTAACATA CTGGAAGCTC ATGAAATGTG
7381 CCTGGCACAC AGTAGTGCCT AATAAACCAT CTCTCTTATT CAGCCTGTTT TCTGATTTCA
7441 GAATCTACAC TTGCTGAGCC AGGTTCTTTT CATTTCAAGG TGAGCAAAAG CATACAAGGA
7501 AGAGATGGAG GTAGGAAGAG ATTAAGCCCT AGGCCAAGGG AGCTGGAATC AAAGGCAATT
7561 TGGTCAGTGA ATAAAAAGGA TTCCAAGGCC CATAAGGCAA TTCTAACCTT AGGATCGAAA
7621 TTCTCGGACA TACAGGAAAT GCTGGGGGGG GGAAAATCCG GTCTTCTCAG CCCAAGAGCC
7681 ATGTGAAACC AGACCTTCAA ATCTGATGAT TCTCAGCCCA GCTGCCCATT AGAATCGTTG
7741 TAATTTAAAA ATACCCTCGG AAAATTCTAA TATGTGGCTA TCAAAGGTGA TCATTTGCTT
7801 TTATGCCACT TTGTTTTCAC CCAAATGGGA CATCCAACCC TTTTCCTTTG AGAGTAGTTG
7861 TAGGGAAAGG AGGGGGTGGA GGGAGGGAAG AGCGGAAAAG GCTGGATCCG CCCCGAGCCG
7921 GTGTCAGTAT CTGGGAAGTG GGAGGCGCGT CAGCAGTAAA CAGCTTCTGC TAGGATTATT
7981 ATCTCCTGCC ACACACTCGG ATTTGAAGGC TCCAAACGAA ACAATGCAAA ACGCTTCAGT
8041 GGAGTTCCAG AAGCGTTAGA CTAAACGACT GGGTCTGTTT GGCCAGTCTG AGCAGCTGGG
8101 CGCAGATGCA TAGGCAAGAC TTAGCCCGCC TAGACTTTTC TGCCCACTTA ATTCCGATCA
8161 AAGCAGAAAC CGGCCGGGCG CGGTGGCTCA CGCCTGTAAT CCCAGCACTT TGGTAGGCAG
8221 AGGCTGGCGG ATCACCTGAG GTCAGGAGTT CGAGACCAGC CCGGCTAACC TGGTGAAACT
8281 CCGTTTCTAC TGGTGGCGGG CGCTTGTAAT CCCATCTACT AGGGAGGCTG AGGCCGGAGA
8341 GTCGTCTGAA CCCGGGAGGC GGAGTTTGTA TGCAGTGAGC CGAGATCGCG CCACTGCATT
8401 CCAGCTTGGG CAACAGGAGC AAAACTCCGT TTCAAAAAG CAAGCAAACA AACAAAAAAA
8461 TGCAGAAACC GAGATCCGGA AGAAACCTC GGCGAGATTC ACAGAATCCA GGAAAATAGG
8521 TCTCTAGAAA TTTGTCCATG GTCCCAGATC TCCATTTCTT GTGGGTGGGG CAGCTGTTAC
8581 CAGATCCCTA GAAGCAAAGG TTTTTTTGGG GGACCGTGTC TCACTGTTGC CCAGGCTGGA
8641 GGGCAGTGGC ACGATCTCGG CTTACTACAA CCTCCGCCTC CCAGGCTCAA GCGACTCTCC
8701 TGCGTCAGCT TCAAGAGTAG CTGGGAGTAC AAGGTATGTG CCACCACGCC CAACTTATTT
8761 TTTTATTTAT TATTTTTATT TAGTAGAGAG GTGTTTCACC ATGTTGGCCA GGTTAGTGTC
8821 GAAGTCGTGA CCTCAGGTGA TCAGCCCCCT CGGCCTCCCA AAGTGGTAGG ATTAGAGGGG
8881 TGAGCAGAAA GCAAAGGTTT TTGAGTGGCC ACAGGCCCCA CTCTATTTCC TTTTCTGCCT
8941 GTAATGGCAA CCTAGACGCT TGAGCTTCTT AAAATACAAG AGTAAGTTGC ATGTCAGGCA
9001 CCGTTCTACA TTAGGGACAT TAGTCTGTTT TACAGACACC TTTCAACTCC CTGGTTAACT
9061 TTTAGGTAAT ATACTCTGCA CTTTAGCAGG AATGGAACCT ATAACTCTCA CAGAATTAGG
9121 AAAGTGAGGC TGCCTACAGC CTAAATTGAG AAAAAAATAG ACGGGGACT AGTCGGAGGA
9181 CCAAACAAGG TTACCAACAC GTTAGAGTTT TGCCTTCAAT TTACATTTTT AAAGTAATCA
9241 CAACGAAGTG TTTAGATCAC GAGGCATCCC TGCATGTAAA CTGTTAGGCA CTAACTATGG
9301 TCGATCTTAC AAAGCATTAA CTAGAATATT TCTTTAGAGT ATGATAGTAC GTAACTGACC
9361 TACTATTACA TACAAACAGA CCAACCTTTA GTAACAGCGC TCCCCAAAAA CCGAAAAGCA
9421 GTAATACGCT TTGCTCAAGG TTGGCATAAA ATTAACTTAC CTTAGTGCCT TTTTTCCTTC
9481 TACCTACAAG CAGTGAGGTT AGCTCTTCCT TTGAAACGGT AGGGGGGCTC TGAAAAGAGC
9541 CTTTGGGTTT GATAGCGTTT CCGGGAGCTC AGATACCTGT CAAATCACTT GCCCTTGGCC
```

```
 9601  TTGTGGTGAC TCTCGGTCTT CTTAGGCAGA AGCACGGCCT GGATGTTAGG AAGGACGCCG
 9661  CCCTGAGCAA TGGTCACCCG GCCTAGCAGT TTGTTGAGCT CCTCGTCGTT GCGGATGGCC
 9721  AGCTGCAAGT GGCGCGGGAT GATGCGAGTC TTCTTGTTGT CGCGAGCCGC GTTGCCGGCC
 9781  AGCTCCAGGA TCTCGGCGGT CAGATACTCT AACACCGCCG CCAGGTACAC CGGCGCGCCT
 9841  GCCCCAACCC GCTCTGCGTA GTTGCCTTTA CGGAGCAGGC GGTGCACTCG GCCCACCGGG
 9901  AACTGGAGAC CAGCGCGAGA AGAGCGGGAT TTCGCTTTGG CGCGAGCTTT GCCTCCTTGC
 9961  TTACCACGTC CAGACATTGC AATCAGACAA AAATCACCAA AACCAGCAGC TAAGCTCAC
10021  GAGAAAACAA ACAAAATCAA GAAATATGTA AAACATGGCC GCTTTTATAG GTAGTTCCTG
10081  GGGAGTAAAT CCGACTTTTT GATTGGTCGG TAGCAAATGC TAGTCAGATA GCCAATAGAA
10141  AAGCTGTACT TTCATACCTC ATTTGCATAG CTCTGCCCAC GGATGACAAC TGTGTAGTTT
10201  GTCTTCCAAT TAACTAAGAG GTACTCTCCA TCCCTCATTA GCATAAAAGC CCTATAAGTA
10261  GCAGAAATCC GCTCTTTACT TTCGACACAT TTCTGGTGTT TTAAGATGCC TGAGCCAGCC
10321  AAGTCTGCTC CCGCCCCGAA GAAGGGCTCC AAGAAGGCAG TGACCAAAGC GCAGAAGAAA
10381  GATGGCAAGA AGCGCAAGCG CAGCCGCAAG GAGAGTTACT CTGTGTACGT GTACAAGGTG
10441  CTGAAACAGG TCCATCCCGA CACTGGCATC TCTTCCAAGG CCATGGGCAT CATGAATTCT
10501  TTCGTTAACG ACATATTTGA GCGCATCGCG GGCGAGGCTT CCCGCCTGGC GCATTACAAC
10561  AAGCGCTCGA CCATCACCTC CAGGGAGATC CAGACGGCCG TGCGCCTGCT GCTTCCCGGA
10621  GAGCTGGCCA AGCACGCCGT GTCGGAGGGC ACCAAGGCCG TCACCAAGTA CACCAGCTCC
10681  AAGTAAACAT TCCAAGTAAG CGTCTTAACA CCTAACCCCA AAGGCTCTTT TAAGAGCCAC
10741  CCAGATACCC ACTAAAAGAG CTGTGGCCAG ACGCCAAATT TTATTTGGCG GCGGAGGGGT
10801  ATTAGAATGT AGGAACTGGA GAGGGGTGGG GACAAGTGTT GCAGCTTAGA GAGGGACAAA
10861  GGGTCCTGAA CCCGAAAGAA GCCAGCCATT AAAAATGGGT TTGGGGTCAA TTCGTTGTGC
10921  TTAAATTTAA AATGGGGACA AGCGGCCATT TTGCTAACTC GGCGTTCCCG GAAGAAACCG
10981  CAGGCTCGCT TAGGTTTCAG ACCCAGCTGT CTGTCCCTGT CTACGTCGCC AGGATCAACG
11041  GTTGCCGTAA TGTCATAATT TCGCCACCAG CTTCTAGCCA ATAGGCTGTC CTGTCATTTT
11101  AAATATTAAC CAATCGAGGG AAAGCTGTTT TGAGACTCTG ATTTACATAG CGGACCGGAG
11161  TGGGAACCTG GGCAGTAACT GCCTAAGGAA GGACTCCCCC TCTGTTTTCG TGGCGCACAC
11221  CTTCGTAGTA TACTGAAGGG TGTGTCTCCT GGGTTTCCAA CTGCCCCGGT AATAGTCTTT
11281  TAACCTAATA TGCGTCAGTT TTGATAACAA CACTAAGGCA GTACAGAACT AAAGATGTAA
11341  GCACTGCGCC AGATGTTGCT TCATACATCT TATTCTATTC AACTGGTTTA TTCAAGATTC
11401  AAATCAAATC AAATTTTGCT TGAATCCCAG TGCTCAGTCA GCCATAAATG GTGTGTTGCC
11461  TGATTGAAAC TTAAAATCTC CGTAGGGGGC TTGTAACATG CAGAAAAGTT TGAAAGTTGC
11521  TTTAGGAGAA GCCAACTCTT AACTGCTGGG TAAATTGACA AGCCTTCGAA CACTGAACTG
11581  AAGGCCAGTA AGGACTAGGC GCTGGGTGGG GGAGAATGAA GAGGAGACGT CATTAAACTT
11641  AGCACATACA CTGTGTCTCC TAGAGGACTC TCCCTTCCTA GACAACTGCA GGCCGCTTTG
11701  TGGCCTGGGA AATTCCACAT TCCCTTAAGT ATTTTACTCA TGGTCTTTTC CAGGTAAAGA
11761  TTTTAAGATG AAGGGTTAGA CGTAGTCTAC CTATCTTTTT ATTCAAGTCT AGAACACGTT
11821  TTTAGCACCT AGAAGTTTGC TTTCTCCATT AAAAACCGGG AATATACAAT AAATAAAATT
11881  AGTGTTAAAG CAGATTTTTA CAAACTTAAA TACCATGTAA TTTAGGTTAC AGTTACTTAA
11941  CATAAGGACT GTGTGATCTT AAATCTGCAA TTTCTTTCAC ACCTGGGAAA TAAACTAAGG
12001  CCTGTCTTTG GTGCCAGACA AGGCCTTATA CTTGAACACT GCTGTGCAAT CACAGGCTGC
12061  CTTGCCTAGA TAACTTATCT GAGAAATTCT GATGAGAAAT GAAATTTCCA GAGTCCCTCA
12121  CAAGTAAATT TTTTTTTCTT TTTTTTTTTT TTGAGACGA AGTTTCTCTC TTGTTTCCCA
12181  GGCTGGAGTG CAATGGCGCG ATCTTGGCTC ACAGCAACCT CCGCCTCCCG GGTTCAAGCC
12241  ATTCTCCTGC CTCAGCCTCC GGAGTAGCTG GGATTACAGG CATGCGCCAC GACACCCTGG
12301  CTAATTTTGT ATTTTTAGTA GAGACGAGGT TTCTCCATGT CGGTCAGGCT GGTCTCGAAC
12361  TCCGGACATC AGGTGATCTG CCCGCCTTGG CCTCCCAAAG TCCTGGATTA CAGGCTTGAG
12421  CCACCGCGCC GGGCCTAAAT GGTTTTTTTT TTTTCTATGC CTCTAATGGA CCTGGTCACT
12481  TATTCCCATT CAGACTGACC GCTCTCCTAC CTGCCAACTA ACTAATCAGT GTAACCAAAA
12541  TCTGCAAACA AAATTCAGTA TTCTTTCCCC GCCTTTTCCC CTTTCTCTTA CATAGATTAT
12601  GTTTTGCCT GTGTTAGATG AAATAATTCT ATTGCTTGTT CTCTCTTCTG TACAAGTACC
12661  CAGTAAGCAA ATTATTAACT TCTTGGTCAT TTATTTCTGA ATTTTCCACC AAGACAGTGT
12721  TTATGTGAGT CATACAATAA GAACCAACAG AAATGTGTGT CTTGGAAACA GGTTGTCTAT
12781  CCCTGGACCC TTTGAGTTTT CTGTTCACTT TCCTTTGGCT TTTGCATGCT AAAAGTTTAT
```

Figure 2 (Page 4 of 74)

```
12841  CGTCCGCGTT  TGTTTGTTTT  GGTTATTCTA  ATTGGACTTG  GCTGATTGGT  TGCATATTGG
12901  TGGCAGTAGT  AGAATTTGAA  TTCTGGTTTT  CTGGTCACAT  CATTAAGTGA  TTAGTCAGTG
12961  GAGAGGACAG  GAAATCTGGT  TTATTTATTA  ACCTTTTTTT  GGGGTGTTTT  TGTTTGAAGA
13021  TGTTGATATT  CTCTGTGAGG  ACACAGGGTT  AGAGTTGGTG  TTTTTCTTTC  TGACTTTACA
13081  TGGGATTTGA  TGTTTTGTGC  TTGTATGCCT  CTTTCCACCT  TCCAAAACTT  GTCTTTTTTG
13141  AGTCCAAATA  GTTGTCGATA  TCTGCAAAAC  CAGTATTCCT  GTGTTAAGAT  GATATGAATA
13201  TAAAATGGCT  GCCCTGTTAT  AACTTTTGAC  TTTAAGAAAG  TGTTAGGACT  AACAGGAGAC
13261  AAAAAGGAAA  TCAAGGAAAC  CAAATGTCTG  GTCTCAATAA  CTGCTATGGC  AGAGGCTCTA
13321  CAGCTTATTA  TTAATTTTAG  TAATTTCACA  TTATTGCCCC  TTCACGTTCT  TTAAGTAAGG
13381  TTAGAGGACA  GAAGAAACAT  AATGTTGTTA  CAAATTGGAC  TATTGAGTCA  GGAAAAAAAA
13441  AGAGTGCTTT  CAATATCTGA  ATAAAACAAA  GATTTAATAT  TTTCTAAACC  TTAACGAGTT
13501  TATTGTAAGG  GATGTGATGC  TGGAAACTAG  GAAACTAGAA  TTTTCTTCTA  AACTGAGAAT
13561  CAGAATTATT  CATATTCTCA  GCAGTGGTGC  CACCTGAGGG  ACTTCTGATC  TTAATTACAT
13621  ACTTTTATTT  CTTTAACTGA  TCAACATGCT  AAATAGATAA  CCTATGGCTC  TGTTTTTACC
13681  CACTTTAAAT  TCTGTTCTAT  TAGCACGGTT  AGCTTTCCTA  ATTGGCAATA  AGATTGAGAC
13741  TATCTTTTTT  TTTTTTTTGA  GACAGAATTT  TGCTCTGTGG  CCCAGGCTGG  GGTGCAGTGG
13801  CACAATCTCG  GCTCACTGCA  ACCTCTGCCT  CCAGGGTTCT  AGCAATTTTC  CTGCCTCAGC
13861  CTCCCCAGTA  GCTGGGATTA  CAGGTGCACC  ACCACGCCTG  GCTAATTTGT  GCATTTTTAG
13921  TAGAGATGGG  GTTTCGCCAT  GTTGGCCAAA  CTGGTCTCGA  ACTCAGGTGA  TCCACCTCGG
13981  CCTCCCAAAG  TGATGAGATT  ACAGGCGTGA  GCCACCGTGC  CCAGAAAAGA  CTATCTTATT
14041  TTATGAATTT  AAATAATTGT  GAAATTATCC  ACTTAAGGGA  ATTAATAAAT  TATAATGTAA
14101  TCTTAAATTT  TAGTTGGCTT  ACATAAAGAC  TTAAAATACA  TCAATTTAAA  TAAAAACTCA
14161  TTTGTCTAAA  AAAAAATCAA  AAATTTTCCT  TGTGCTTTAA  ATGTGCTACC  TCTTTAAGTT
14221  CTAATTAAGA  GAAAAAAAGT  TTAACTGTGA  GTTTCATTAG  TGGTCTTAGT  TAACAGCTTA
14281  AAGTATTTTG  TAAAAAAAAT  ACTTCACAAT  TTTTAAATAA  CTTAAAAATA  TTAATACCTC
14341  TTTTATTAGG  TTTTTTTAAT  AAGGAAAATA  TATAATACAT  CTAATCAAGA  TTATTTTTTG
14401  GACAAATTGG  CTTAATAATT  TCATTTAAAA  AATGGCTTCT  TTATTCTTAT  ACTGTAAAAA
14461  TAATATTAGC  AGAATATTAT  AGTATACACA  AGTTTAGGGT  TCATATTCTA  AAAAACAAAA
14521  ACAAAAGCTA  ATTTAACTTG  CATTTACTAA  ATTTCTTCCA  CTAGTTGTAC  TGGTTACATG
14581  AGTTAACATC  ACTTTATTTA  TTATTCTAAA  ATTGTAAATT  ATTCATTGAA  CCAAATTAAA
14641  TGATAATAGA  TAATGTCATT  TTTAAAAATG  GAATTAAATT  TTATGTTACT  AATTATAAGG
14701  ATTCAATGTG  TGAGCTTAAG  TACTGAGTTC  ACAGTGTATG  ATAACTTTAA  GAATTTAGGT
14761  GAATATTATT  AAATTGAGTA  AATTAATTCT  CAATCTTTGG  ATACCTGGAC  AATTTCTAAA
14821  TTGGAGGGTA  CAAAATACAA  ATCACAAGAA  ACAGTGTAGT  TTTATGCAAA  TAACATTTTT
14881  ACACAGTTTA  GAATAACCAT  TGATAAACAG  ATAAGAGAAC  ATATGATTGC  CTTAGAATAG
14941  ATACTGTTGC  TTTCGCCACT  TTAGATTTGT  AAATCATGTA  CTGTATACGT  GTGGGCGTAG
15001  AGGACCATGC  AGGTTTTGGA  TGACTGCCTC  TGTTTTCGTC  ATGCCTATGC  GGGAACACAA
15061  TTGCCTGCTT  TGTTTAAGGG  CTATGGTTAA  TCCAAACAGC  TCTGACTCTA  TCAAGTACTA
15121  TAGCTACAGA  GAAACACAAG  TAAGCATTCG  AGATAATGAC  TACCTTGAGC  CTTTACTTAT
15181  TTAAAAAGTT  GTTACTGTTT  GTTAATGTGG  TACATTCAAT  TTACTATGGA  TTGTCACTCT
15241  AAAATAAGAC  TTCAATCTTT  TTCTTATTTT  TATATAGCCA  TGATTTATAT  TCATATCTTA
15301  ATGTAATAAC  CAATCTTCTC  TGACAACATT  ATAACAATGC  TGGAACCTCC  ATTTTCAGTA
15361  CTTCAAACAA  CAAATACTGC  TTTTATACTT  CAGAGCAGAT  GGATATGTGC  TTCCCAGTGT
15421  AAACACATTT  GGAATCTCAC  TGAGAAATAC  ACTATCACTA  AAAATACAGT  TCTGAGATTC
15481  ATTAAAAGAC  CTCCAGAATT  CTGGAAGTAG  GAAGTTTCCT  CTTCAAAGTC  TACAGAGGAA
15541  GACGAGGTCT  GAAATAGACA  GCTTCTTCCT  TCTTTTACCT  GTGGTATTAT  TCTGTTTTGT
15601  CCTTTTCTCC  ATTATCTGTC  TTTCCAGTGA  TGAAATTTTG  ATCTGGCCCT  CCCAAGTATT
15661  AAAAACAAG  CAAATAAACA  AATCTCAGTT  ATATTTTACT  AAGATATTGG  CATGCTAACT
15721  TTTTGCAGGT  TTGTAACAAG  GACCTTTATA  ACTTGACTAA  AAGTTCCTAA  ATAAGAATAT
15781  TTACTAGAAA  ATTTATTTCT  GCCTGTGGCC  CACATTTGAG  TCAAATAAT  CAATTAGGAA
15841  AAATGAACTT  GTTAACTAA  AGTTGGCCAA  ACTGATCTTT  GAGACCTATT  CATCTAAGAC
15901  AAGCCAATTA  AATTCTTGGA  GACAATTTGT  ACTTTAAGGA  ATTCTTATAA  TATTTGTAAT
15961  TACCCTCATA  ACTTTTTTTT  TGCCCTACTT  CTGTGCTTCT  CTAATATGCA  GATTATTAAA
16021  TGTTGTTACA  AAGCCATTGT  CAAAAAAACA  AAAAACAAAA  AACTAAACAA  ACTCACATGG
```

```
16081 TTAGACTTGC TCCTTTATGA GATATTTTTA CCAAAAATGG AGGAGTTGAA AAACTCTGGT
16141 GCCAGAAATC GTGAAGACAT GGCCTACCTA ACTTGGAAAT GTTGGTTGTC AGTGGAAAAT
16201 ACTACACAGA GATAGCCATA GTGCTGCACA GCCAATCTTA AGTGTTTCTA GAGAATCACT
16261 AATTGTTTCT AGAGAATCAC TAATTGTTTT CTTTTAACAT TCTTGGTTTA TACAAGAAGA
16321 GAGTATCCAT ACTAAACTCT TTTCTACTGA AAATAATGTG CAAACATAAC ATCCTATTCC
16381 TAGACAGTTT GTAGTTTTTT CTCCCATTT CTATTTTATA AATCATCTTT TTAAAATACT
16441 TTGTTGAGTG AAATCAGTCC ATTGCTTGAT ATACCTTGAG CACAAGTAAA TAGTATGCCA
16501 AAAATTAAAT GTCTTTCAGT CACAGTTTGA CAAACTCAAC TACCCTGAGC CTATAGAGTG
16561 GTAATAATTG CCCTACTCAT AAAGATGGGG TGAAGATTAA ATGAAATAGC ACCTATAGAA
16621 CACTAGTTCC AGACGTGGTA TCATGCTAGT AAAATGGCTG CACAGCACTG CTCAATGATG
16681 ACAAAAAGTG AAGCTTCTGG AGACAGACTC CAAGTTTGAC TCCCAGATCA CCACATATAA
16741 GATGTGGGAC TCTGAGGCAG GTCATTTAAT CTCTCTGTGC ATTAGTATCC TTCTCTATAC
16801 CTTTACAGTG ATGGTAATAG CACCTACCTT CTAGAAGTAT GTGAAGATTA AAGATCCTTA
16861 ATGCATATAA ACCACTGTGT TTACTGCTGT TTGACAAATT TTATTTATAA CCATCTTTAC
16921 GCTCCTAAAA GGACTTGAAG CAGCTTATGA CTGAAGACTT TGGTAGGAGT TGGCCTTCTA
16981 TAAATTATAA GAATTTCATA AATTATTTGA TATGAAAATG CCAGTTGATC ATAGTATGTT
17041 TACCGGGGTC CAACAGGTTG AGAAAAAATA CACTTTTTTT CCCTGAACAT ATGAAATTAG
17101 CTCTCTAGGC ATATTCCTAA GGACTTAAAG AATGATAACT ATCATTTCTC TTAAATCTTC
17161 CAGATTTGGA AGGATATATA TATTCAGCAC ATTGACAGAC AATCCCAGTA GTCCTAAATT
17221 AAAAGACATT AAAAATTAGT GAAACTTTTC CTACCTTTAG CCTGTGTAAT CCTGGATGAC
17281 CAAGCATAAA ATTAAATTGA GTAGAGTATA CCACTGTAAC ATTTCCTGAA AGGTATTCTA
17341 GGCTCTGAGT AATTTCTTTG GGGTCTGAAG ATCAGTTTGA CATATCCTCA AGTATCATGA
17401 GTTCATTATA ATTAAGAAAA AGGGAGTAAA TCTGGAGAAT GAGCCACTTT CTTACTACTC
17461 CTTGACCTCA GTTCTTTTTT TCAGAGACAG GGTCTCACTT TGTTGCCCAG GCTGCCAGGC
17521 TGGAGTGTAG TGGCGCAATC GCATCTCATT GTAACCTCCA CCTTCTGGGC TGAAGCCATC
17581 CTCCTGCCTC AGCATCCTGA GTATCTGGAA CCACAGCAGG TGCACACCAC CATGCCAAGC
17641 TAATTTTTTA AAAAGTTTTT TGTAGAGATG GGGTCTTACT ATGTTGCCCA GGCTGGTCTC
17701 AAACTCCTGG GCTTAAGTGA TCCTCCTGCC TCAGCCTCCC AAATTGTTGG GATTACTAGT
17761 GTGAGTCACT GTACCCCGCC CCACTTCAGT TCTGAGGAGG AAAAAATATG TAATAATAAT
17821 GGGACTTTGG TTTGCTGATT TAAAGATTCA TGTAACCTTA TCATCCAATG CGCAATTTGT
17881 AGAATAATTA ATAGAGACAT CTGGTCTCAT GTTTCTACAG TTGCTCATGC CTTGATAGTA
17941 GATCTCCTTG CTGCTGGCTC AGAAGGGTAA AAGAGCAGAA ATGATGGGGC TTCTCTCATT
18001 CTATGAGGAA ATAGACCTAT GTAGAGGAGG CTACCTGTGG TAAAACCTTA TCCTCATCAC
18061 TTAAAATTCT AGGCTTATTC TCTGACCATA TCAAGTTTTC AAATGGTAAA GAATTGGAT
18121 TCAAGAGAAA TATGAATAAA CTTTTGTTTT CACTTTTCTC CCTCCTCTCC CCCCATTCTC
18181 CCTTCCTTTA TTTTCTTGTC CTTAGTTTTC TTTTCACTTT TTGTCTACT ATTATTTGCC
18241 CAAACTCAAC TGTAGGCTAG AACAAAAAAA AATTGAAAAT TAAATGTGC CCCTTTTGTT
18301 GTTAGACTTG CTTAAACAAT TGGGGTAATG AACCTTGGAC ACTAGATTTT AAAACACACA
18361 CATTTGAGCT TCAGTGCACT GAAATAAATA TATTTTTAAC AATTAAAAAA TAAAATTGCA
18421 TGTTTAAAAA ATCTGCAGAG AACAATACAC GTTGTGAGAT CTTGAATGGA AGGAAAACTG
18481 CTAGCCTCAA GAGTGGATCA AAGATGCTCA GCAGGCAACA GAGTAAGAGC ATGTTGGAGG
18541 GTTTAGAGAG TGTGCTCAGG GTTCTAGGCT CTAAAAATCA GACAGTCCCC ACGGCCTGGC
18601 CTTCGTCGCT GTATCTTCTT TATGAAAAAC ACTAAGTCTT TTTCCTCACT GGATAAATTT
18661 TTATCCTTCA AGTTTAGATC AAATGGAACT TTAGGACACT GACTAGGTTA CATTCATCTT
18721 TTAAGAGCGT ACAGACATTC AAGGGCTAGA GGATGTGGGT TTACTGCACA GGCTCATTAT
18781 CCAACAGCTG TGCTACCTGG GAAACTTAAC CTCTCTGTGC CTTAATTTCC TCATCTATAA
18841 CGCAGGGAGA ATGACAGTAG GTATCTCATA AGGTTGTTGG AACAACTAAA TGCATTGGTA
18901 TCTATTGTGT AAAGTGCTTA AAACACTGCC TGGCACAGAG CAAACATCCA GTGAACTTTA
18961 GCCATCATCA TTATCATTGT TCTCAGAGTC AAATACAATA TCTCATATCT GATAAATTAC
19021 AGAAGTGAAT CAATCACTCT CTCTCTTTTC TCCAGGGGGA GACAACAGCT TTTAGACATA
19081 TCTTTTCCAA CAGTCGTCAC TGCTGGACAC TGTTTCATCT TGCAAATAAA CCAATGAAAA
19141 TGAGTGATCC TAGAAGAAGA TAAATGGAGG TATTTTGAAC AATCAAAGAA GGACAAATGA
19201 ACACCTGGCT GAGAAAAATT AGCTCTTTTT TCTATGCATA AAACTATTAA AATATTCTTC
19261 ATAGAAATTT ATGACACAGG AAACATAAAG ACAAAATTAA AATAACTCCT AGTATCTCCT
```

```
19321 ATTCTTTTTA TATGTATATT ATATATACTC ATATTCATAT ATACATATAT CTCACATCAT
19381 GTATCATATA TAAAATAAAT TTAGGTGTCA TGATATATAT TTAGATAAAT ATACTTAGAA
19441 ACTTTTTTAT GGATGTATAA TTTATGGATA TATTGATAAT TATGTATTTG TTATTGACTA
19501 CTTCAATTGA TTCCCATTTT TATGCATTAT ATTATAGATT ATATAGCTCA CACATCTTTG
19561 TACATAAATC TTTGTTCAAA TATTATTTCC TAAGGATAGA CTTCATGAAG TGGAAATACT
19621 AAATCAAAAG TGAAAAACAT TTTCTAAGGT TCTTAACATA TACATTGCCA AATTGCTATT
19681 CAGGATCATA CCAATTTATA ATCCCAAAAT AATATGAAAA TTCCTGTTTT ATAGCACTCA
19741 TATTTACAAT AAATTTTAAA AATCACTGTT AACCTAATAG TCCTTCAAAA GAAAAAAAAA
19801 TTGAAATTAC ATTATTTTAA TGACTCTATT AGTGAGGGTC ATTCTTCCCA TGTTTCTTGT
19861 TAGCCATGAC CCTATAAGAA ATAAACTGCA CTGCAAAATG ATAAACATGA TATCAATCAT
19921 TACATGGGAA GGCACTATAT AAAGAATAAT ACCTTAGGTT AAGGCCACAT AAATATTTAT
19981 CAGGTGCCTT TTCTGCGGAG GACTCTGAAG GGATACTAAA CTGCATTTAG CTGCATGCAA
20041 CTGAAATTAC TTTTACCTAC ATTGTCTCTT ATAAACATTA TAACTACTCT TTGAGAAAGT
20101 GTTTACTATG GACTGAATTG TCTCCCCATC CCCCCAAATT CATATATTGA AGCCATAAAC
20161 CCCAATATGA CTCTATTCCT AGACAGGACT TATAAGAGGT AATTAAGGTT AAATGAGGTC
20221 ATTAGGATGG GTTCCTAACT GGATAGGATT GGTGGCCTTA TAAGAAGAGG AAGATTCTGC
20281 ACTTGGTCTT CCAAATTAAA TAATTTATTT AAAAGAAAAA AAAAAAAAGA GGAAGAGAGG
20341 GAGCTCTGCA CATATACTGA GGAAAGGCTA TGTGAGCTCT CACAGTGAGA AGGTAGCACT
20401 CTACAAGCCA GCAAGAGAGC CCTCACCAGA ATCCAGCCAT GCTATACCCT GCTCTGAGAC
20461 TTCCAGCCTC CAGAACTGTG ATAAAATTTT GTTGTTTAAA CCACACAATC TATGGTATTT
20521 TTTTATGGCA GCCCAAGCCA ACAAAGACAG CATCATTGCT GTCACTTACA GACAAGAAAA
20581 CTAAGACTAG GAGAGAGAAA AGTTAAACTT GTCCAAGGTC ACAAAAGCCA GAAACAAGTG
20641 AGGTGAGAAG TTGACCTTGT TCTCCTCAAT CCAAGGCCAG GACTCCTCCA CTCCACATGT
20701 AGATAGCCAC CTCACAGTCA ACAGCCAAAT GTCCACACCC CAGAGTCAGC ATTAGACCAA
20761 GATGTCTTAC CAGGAGACAA ATGCCTCATC TTGAATAAAT ATGTTCTAAC AACTTACCCA
20821 TGTAAAACAT TGAATCTCAT GAGAAACAAA AATGCAAAGT ATGTAGAAAA CTATGTTTAC
20881 CACTTAACTG ACAGTGATAA AAAGCTTAAT GATATCCTTA TAGTCTTGGA GGGGTTTGTA
20941 TATGTGGTGA ACAGGTGCT CACGCACTGC TGATAGACTG TAAATTGGTC CTAGAGAGAA
21001 AAATAAATAA ACTGGAAGGA GTTATGCTGT ATGTTTACTT TTTTTATGGA AACATATGAT
21061 ATACCTGGAA ATTCGATTGG CCATGCATCT ATTTCTTCAA TGGGTATGCA CAGTTGAGCT
21121 GTTCCCATGC ACCAGGCACT GTAATGGGAC AACTGCACAT GACAGTCAAA AATCTCAGTC
21181 TCATGAAGTC GACATGCTCA TGGAGAGGTG CTACCCACTA AACTAATATT TGTATATCAA
21241 TTATGGATAC ATTGGCCCAC ATTTACAGAA ATTCACTTAC AGTGGGTTAC CAGAAGGGAT
21301 TTTTTTTCTT GATTGGCAAG AAGGCTAGGC TGTTTTGTTG GGGGCTGGCA GGAGCTGTCT
21361 AGGCTGCCCA AGTATGCAGG TCTCTTCTAT CATCCTGTGT TAACCATCTT CCATGTATCT
21421 TTCAACCTCA TGGTCATCTG CAGCATGTCT AGGGGTCATA TCTATGTTCC ATGCAGGAAA
21481 AAAGGGTAAA GGGAAAGGGA AGTAGGCATG TACCATTTTA ATGCACACCT TGGTTTTCAG
21541 AAAATTTAAG AAGAAAGACT TTCTGCTTTT CTCTGACTAT TCTGTATTCT GGATTACAAC
21601 GCAACAGAAA CGTCACCTTA AATTCTAATG TTTTTCTCTC CTTGCTTTCA AAAACTGACT
21661 CATTAACCTC CACGTGGCTT GGAAAAATTA TTTCAGTCAT CCAGTAATGA GCTGTTCATA
21721 GAAATGTTTT GGACATCAAG TCTGTGTTGT TAGCATTATA CATGTTAAGC ATTGAATAAA
21781 AAACAACATG ATGTGGGTAC ATTTCTTTAC TTACATATAA GTACTTATAT ACTTATAGCT
21841 GAAAAGAGAG GTTGAAATGT CAGGTGGAAC AGAAATAAGA TTACCTAGAT GTTTCTCCTA
21901 TGGGTGATTT TCAGCTATGC TGATCTTTCT TCTGGGTCAG GTACTCCAG AACTTCCTAA
21961 TTAAATGGTG GCCCTGATCT TAGTTCCTCT CTCCTCTTAG ACATTTTCCA GGACTACAGA
22021 AGATGTGCAG TTTATAAATG AGTAGCAGAA ACCTACTGAA CAAATTATTC AGGCTCATCT
22081 GAACAGAGAG GACACCTTCT CTGCTATACT CTCTCAGTGA TTTCCCTGCC TTGGGGTCAA
22141 TTATTGTCTT GGACATTGAT TTAAGCACAT AATAATTGTT GTCATTGCTT ATGTTTGGAT
22201 TTCATCTCCC AAAATAGATG GTAAATTCTT TAGTTTAGAG ACCAAGTAAT ACTTACAAAA
22261 AAATTTTGTG TGTGTGTGTG TGTTTTTTCT GTGTCTCTCA GCCCTGTAAT AGCATCGTAC
22321 TTACACTTGT TAGATTTTTA GAGACAACTT TTACAAAACA TGGAATTATC TACATACCCT
22381 TTCTACAAAA CAGACAAATT AAATACTCAG TAGTTGAACC AAAAAAAGCA GTTCAAATAA
22441 AATACTTGAA AATGAAGAAA TCATTTGAAC AGAGTTAAAG TTAATCGTAA AATAATGTCT
22501 GTAAAAATTA TTGCCAATCA AATATAAAGT TCAAAAATAG TGCTTGAAAA AGGAAGAATC
```

```
22561 ATATGAAAAG GGACTACTCA TTTTAAAAAT GTTAGATATC AGGAAAAGCC AAGAAGTGAG
22621 TATGGTAAGA GTGCTGTCAA GTGAAACCCT GCTAATCTCA CTGAACATGT AAAAATCTGT
22681 AGATGCCTTT ATTTTATTCA CTCACACACA TATGTAGAAA GAGAAATATA TGGTAAACAT
22741 TAAAAAAAAC AAATTAGAAT GTAAATTAA TACTTTAAAA AATGGGCTGT ATACTTTTCT
22801 TATCACCGGA GATAAGAATT TATTATTTTT AAAATAAAGT TATTTTCTCT GTGACTGTTT
22861 CCATGACTTT GCTACTTAGA AGTTAGAGAT GCCAAAGTTT ATCTAAGAAA ATGTTTATGG
22921 AAATATTATT TCAATAATGA ATGTTTAGAA GACTGAATTT CCTGACTGGG CACAGTGGCT
22981 CATGCCTGTA ATCCCAGCAC TTTGAGAGGC TGAAGAAGGA GGATCGCTTG AGTCCGGGAG
23041 TTCAAGAGCA TCCTGGGCAA CACAGCGAGA CCCTGCAGCA AGTAAAAAG AAAAAAGAAT
23101 TGAAAAGGA AGACTGAATT TCCTTTGGGC AAGTCATGTG ACATTCCTGT GCCTCAGTTT
23161 CTTCATCTAT AAAGTTAATT CCTACATTTT TGGGGAAGGG AGAGAAAAAC TTAGGATAGT
23221 GACTGGCACA GAAGAAGCAC TATATACTAT ATATATGTGG ATATCATTTG TTTTTATGGT
23281 ACCATTTTAG CTATCTAATG CAAAATATGA ATCTTTTTT TCTGGGTCTT AAATTATGGA
23341 ATGTAAGAAT TTTCTAAATT CTCTAATTCT GTGTTAGTTT TAAAGCAATG GAGTAACGTA
23401 TCTGTCAACT TGTAAATATA AGGATCAACC TGATCCACAA TTTGACCCCT AGCCACTAAT
23461 ATTTAATAGT ACAACACTCA GAAATTATCA AAGGTCAGAG AAGCCAAACA AATGTAAAAA
23521 CATACAGGTG CTCAGAAAGA TGCACCTGTA ATCTCTCTAA GGAGAAATAT TTTCCAAACT
23581 GAGTGACACG GTGCTTTAGT GAGTTGTGGA ATCAATCTCA TGATTTCCAA CCTAGTGTTC
23641 TTTTAAAAAT GAACTAGTCC ACAGTAGAAT ATACTAAAGT GCTGGTGCTT AAGATAGTAT
23701 TGTTTTCTGG AAAAAAAAAA AAAATTTTTT TTTTTTGAGA CAGGGTCTCG CTCTTGCCCA
23761 GGCTGAAGTG CAGTGGCACA ATCATGCTCA CTGCAGCCTT GACCTCCTGG GCCCAAGTGA
23821 TTCTCCCACC TCAGCCTTTT GAGTAACTGG GACCACAGGT ACGTGCCACC ACACCCGGGT
23881 AATTTTTTAA TTGTAGAGAC AGGGTCTTGC TATGTGCTTA GGCTGGCCTT GTGAACTCCT
23941 GGGCTCTAGT GATCCACTAG CCTCAGCCTC CCAAATTTAT GGGATTATAG GCATGAGCCA
24001 CCCTACCTGG CCTGTTCCCT GAATTTTTT TTCTTTCAGG TGTTTGTGCA TATGTGTGTG
24061 TGTATGGGTA TAACAGAGAG ACAGAGAGAA AGAAACTTTT CTATCACACT TTGCAATCAG
24121 AAGTTTGAAG TCTTATCTTT TGGCTTTTGT TTCAGAAATA TTTCAAATGT AGACTCTCTC
24181 CTTTACCACA CTGTCCCCTT AGGCAAGGTC TTTGCCATTC TTCTGAGACT ATTGCAACAG
24241 ACTCCCAACT TCTGACTGTG GGCCCTTCTC AAAAATGATT GTTTATGCAA TAAATCTAAA
24301 CCCAAGACAA CTACAACAAT ACAACAAATT CTCTGCTTAA AAACTTCCAA TGTCTGCCGG
24361 GCGCGGCGGC TCACGCATGT ATTCCCAGCA CTTTGGAGGC AGAGGCGGGC AGATCACTTG
24421 AGGTGGGGAG TTCGAGACTA GCCTGGCCAA CATGATGAAA CCCCATCTCT ACTAAAAATA
24481 CAAAAATTA GCCAGGCATG GTGGTGGGCG CCTATAATCC CAGCTAATTG GGAGGCTGAG
24541 GCAGGAGAAT TGCCTGAACC TGGGAGGTGG AGGTTGCACT GAGCCAAGAT CACACCATTG
24601 CACTCCAGCC TGGGCAACAA GAGCAAAACT CTGTCTCAAA CCAAACCAAA ACAAAACTTC
24661 TAATATCTAC CAAATGTTTC ACACAAGTAT TTGGGGATCT TCACAAATGG CCCTTATGGA
24721 GTTTTCCTTT GCTGAGACCC TATGCTCTGG CCACACTAAA CTCATTCAGC ATCCCAGAAA
24781 GGCCTCAGCC TTTGTGAGCA AGCTCTTATC TCCAGGCCTC TCACAAAGAC CTGTTCCAGT
24841 AGAAGCTCAG GGGAGCACAC TGGACATTAT TCCAACAACC CTTTCCCCAC AGCTATGCAG
24901 CCAAATCTGC CAGCTCAGTT AATTAATTAA GCAATTCAGA GATGAGGGTC TGCCCAGGCT
24961 GGAGTGCAGT AGCTGCGACC TCAAGCTCCT GGGCTCTAAG TGATCCTCTT CAGTCTACCC
25021 AGAAGCTGGG ACTGCAGGCA TGTGCCACCA CACCCAGCTA ATTTTTTTTT TTTTCAGTAG
25081 GGACCAGGCC AACCTAGTCT TGAACTCCTG GCCTCCAGCC TTCCGAAGTG CTGTAATTAC
25141 AGGCATGAAT CACTGCGCCC AGCCAACCCG CCCAGTCTTG TTAGACATGG GTCTGTAGT
25201 TTCTAGTAGG TTCTTGAGTC TAGGGTTCCT ACCTCATGTT TTATAGTTAA TTTAGGGGAG
25261 GGACTGTGTC TGTTTATCTG GGGATGTAGG GGTGGGCAGG GGGATAGAGG GGACTTCAAT
25321 TAATGAAACC AGAAGCAAAA CTCAGTTGAG GACACCGGTC ATGAGAGTGG CCTGATTATG
25381 GCCAATCTTA CATAATGTGT GAGATCTTGA TATTACCCCA TCCTTGAGAG TCCTCTATAA
25441 AGCTACAGGG ACTTGGGAGC ACCTTTAATT ACAGACAACC CATGTTCCTG TGGATTATGA
25501 TTTATTAGAT TGCACATGCC TAAATAAAGA CATCCTCTGC AGTCTTTTGA CAATTCTATA
25561 AGCATCTTCT GACTCCGCAA TTAGACAGCT AAGAGATCTG TGTTACTTCC CTCACATATA
25621 TAAATAATTT TAAATAAAAA TCATGGCGTG AATAATTTCT TTCCTCTACC GATTTGAAGC
25681 TATCCATTTG GAAGACCACT CTGAAGAGAT GAAATAAGTC TTCTGCCAAA GATTACTTAT
25741 TAATTTACAA GGAAAAGGGG AAGTTTTGTT CCTCTCCGTG AATTTGATTG AAAATCGAGG
```

```
25801  GCTTTCTCGA  ATAGTTTTGG  CATCCAGGGT  CATTTTTCAT  TAAAAAGAGA  AAAGTCATGT
25861  CAAATATGAA  TTTCCGCAGA  TTATTCAGCA  CTAGACCCTG  GGAGATTCTG  TAAAGAGGGG
25921  TTTTGTTATA  CTCAACTTTT  CCGGGTAAAA  CAAACACAAA  TACTCCTCCT  CCAAGGGGCG
25981  GGGGCGGTGC  CTAGGTGATG  CACCAATCAC  AGCGCGCCCT  ACCCTATATA  AGGCCCCGAG
26041  GCCGCCCGGG  TGTTTCATGC  TTTTCGCTGG  TTATTACATC  TTGCGTTTCT  CTGTTGTTAT
26101  GTCTGAAACC  GTGCCTGCAG  CTTCTGCCAG  TGCTGGTCTA  GCCGCTATGG  AGAAACTTCC
26161  AACCAAGAAG  CGAGGGAGGA  AGCCGGCTGG  CTTGATAAGT  GCAAGTCGCA  AAGTGCCGAA
26221  CCTCTCTGTG  TCCAAGTTGA  TCACCGAGGC  CCTTTCAGTG  TCACAGGAAC  GAGTAGGTAT
26281  GTCTTTGGTT  GCGCTCAAGA  AGGCATTGGC  CGCTGCTGGC  TACGACGTAG  AGAAGAATAA
26341  CAGCCGCATC  AAACTGTCCC  TCAAGAGCTT  AGTGAACAAG  GGAATCCTGG  TGCAAACCAG
26401  GGGTACTGGT  GCTTCCGGTT  CCTTTAAGCT  TAGTAAGAAG  GTGATTCCTA  AATCTACCAG
26461  AAGCAAGGCT  AAAAGTCAG   TTTCTGCCAA  GACCAAGAAG  CTGGTTTTAT  CCAGGGACTC
26521  CAAGTCACCA  AAGACTGCTA  AAACCAATAA  GAGAGCCAAG  AAGCCGAGAG  CGACAACTCC
26581  TAAAACTGTT  AGGAGCGGGA  GAAAGGCTAA  AGGAGCCAAG  GGTAAGCAAA  AGCAGAAGAG
26641  CCCAGTGAAG  GCAAGGGCTT  CGAAGTCAAA  ATTGACCCAA  CATCATGAAG  TTAATGTTAG
26701  AAAGGCCACA  TCTAAGAAGT  AAAGAGCTTT  CCGGGAGGCC  AATTTGGAAA  GAACCCAAAG
26761  GCTCTTTTAA  GAGCCACCCA  CATTATTTTA  AGATGGCGTA  ACACTGGAAA  CAAGTTTCTG
26821  TGACAGTTAT  CTATAGGTTT  AAGTTGTGAT  GCAGCTGAGT  TGAAAAGGCT  TGAGATTGGA
26881  GAATTAATTC  AGGCCAGGCT  TCAAGACCAT  CCTGGGCAAC  ATAGCCAGAC  TACCATCTAT
26941  ACCAGGGGTC  CTCATTCCCC  CGGCCACCGA  CCGGTAACCG  GTCCCTGTCC  ATGGCACGTT
27001  ATGAATTGAG  CCGCACAGCT  GAGGGGTGAG  CGAACATTAA  CCAACTGAGC  TCCACCGCCT
27061  GTCAGGTTAG  CTGCAGCATT  AGATAGATTC  TCATAAGCTC  AAACTGTATT  GTGAATGGCA
27121  CATGCAAGGG  ATCTAGGTTT  CAGGCTCCTT  GTGACAATCT  AATGCCTGAT  GATCTGAGGT
27181  TGGAGCAGTT  TTAGTCCGGA  AATCATTGCT  CCCAGCCCCT  GCACCCCTG   GTCCGTGGTA
27241  TAATTGTCTT  ACACAAAACG  GTCTCTTGTG  TCAAAAAGGT  TGGAGACTAC  TGGTTTTACA
27301  AAAAAGTAAA  TTAGTCAAGC  ATGGTTGGCA  CGCTCCCTTA  GTCCCTGCAC  CCAGGCGTTT
27361  AAGGATACAG  TGAGCTATGA  TGGTGCTACC  TCACTCCAGC  CTGGGTGACA  GCGAGTCAGA
27421  CGTTGTCTCA  AAACTTAAAA  AAAAAAAAAG  TTAAAACAGA  AAAAGGGCTT  CTTGTCAGAG
27481  ACTGCCGTAT  ATCTAGAGGT  CCAGGAACTA  AAAAGTCTGA  TGTCCAATCC  TGAAAAGCTC
27541  GATGGTGCAC  TAGAGGAGGC  TTTTACATGT  AAGAGCATCT  AAGTTCTGGA  AATGCCAGTG
27601  TCAGGGAAGG  GAAGTGGAGA  GCAATTTGGC  ATCCAAACAT  AACTTGCTGA  TACTTTTTTT
27661  TTTTTTAACA  CAAGTACTAC  ATTCTAGTCT  TTCTGTGGTG  TCATTGTAAC  TATTGTTTCT
27721  TAATATGCTA  TCCACTGACT  TCAAGGGATC  AATAAATAGG  AATCAAGGTG  TCCCAGAATA
27781  TGGATTAGGG  GAGTTTTTTT  TTTGTTGTTG  TTGTTGTTGT  TTTCATCTAT  TCATTATCCT
27841  GTAGCTGAAA  TTTAGAATTT  TCTTCCATTG  TGTGTGACTG  ATAGAAATAA  CAAATTTGTA
27901  GGTTATAGTT  GTTGCAAGAA  TCTGGAAATC  GTGCTTGCTT  ATTTCCGAAG  TACTATTAGG
27961  TATATCAACA  AAAACACACA  TATTACGGTC  AAGTGGTTTG  ATAATTATTT  TAATATTATT
28021  GGTCTAATAC  AATTGTAACC  CTATGAATTA  CTTTAAGTAT  CTTATTTATG  AAAAGAATCT
28081  GTAAGTTTCA  TCAAACTACC  AGAGCATACC  GAAGACTGAA  AAATTTTAAG  AATCCAAACC
28141  TTAATGGAAA  TGTTGGAGGC  TGCCCAATTA  GGTTCTGAAT  TCCACCTTCC  TGAATCACAA
28201  ACTTGTTTTA  ACTCTCAGTC  TGAGGTAAAC  TACGTTTCTC  TTTAAACAGA  CATAGTTTAA
28261  TTTTCCTTTG  ATTTTTGATT  TAGTATTCTT  ACTGATCATC  ATAAATAACC  AATGCTAATG
28321  TTAGTCTACT  TTGGACCATG  GTATTTCGAG  AAACTTTGAA  CAAAGTCCCC  TGCAAAACTA
28381  TGCATTGCAT  TATTTCACAT  ACATTTATGT  TTTCCAGACG  GTTCAATAGT  ACCTCACTTT
28441  TCTGAACTTA  TTTGTATAGT  TTGGCATCTT  TTTAAAAATT  GTGTCCTATA  ATGAAAGGTT
28501  GTAAACATTA  TGTTTAAAT   TTGTATAGAT  AAAATCAACC  ACAGACCTTT  CCTTGCTTGG
28561  ATGTAATTGC  CATTGTTTCC  CAATGAGTTC  GGAATTACTA  GGATTGTGCA  AAAATATGCC
28621  TCACTTGCCT  GACATAGCAG  AGAGCCATTT  TGCCTAAATG  CTGTGCCCAG  CAATGGACTG
28681  TCACCAGATT  CTCATCACAT  ACAGTGAGGA  TGAACAACTA  GCCTCTCCCA  GCAGCTGGCC
28741  GGTCTCTCAA  TAATATGGGA  CTCCCTCAAG  ATGGCTTCCT  GCACCTTTGC  TCCTCTAGCC
28801  TTGTATGTAT  ACAAGGCTAG  CATGCCTGGC  ATACATAAGG  TTAAAAACAA  AATCAATAAG
28861  TTATGGTTCT  TCCTCCAGTT  CTGGGGATTA  TTAGACCACT  TTTTTGTTTT  GTTTTGTTTT
28921  GGATGGAGCC  TCGCTCTGTC  ACCCAGGCTA  GAGTGCAGTG  GCACAATCTC  GGTTCACTGC
28981  AACCTCTGCC  TCCTGGGTTC  AAGCAGTTCT  CTGGCTCAGC  CTCCCACGTA  GCTGGGATTA
```

Figure 2 (Page 9 of 74)

```
29041 CAGGTGCCCG CCACCACGCC CAGCTAATTT TTGTATTTTT AGTAGACGGG GTTTCACCAT
29101 CTTGGCCAGG CTGGTCTTGA ACGCCAGACC TCGTGATCCA CCCACCTTGG CCTACCAAAC
29161 TGCTGGGAAT ACAGGCGTGA GCCACCGCGC CCGGACTTAG ACCACTTTGT TTTGGCCAAT
29221 AGGACAACAG CCATAGAACC CTCCGCAAAT GAGAGCTTGT CCCTAAAGAT GCTTTATTTA
29281 CATAGCTGTG TGCCGCATGA GCCAAAGGT GATAACCTTT GTTCAACACG CGCCTCCAGC
29341 CCTTCGGTTA AGTCCAAAGT ACCATTCTTA GAATGCTCTA AAATACATAA TTTTTTTTTT
29401 TTTTTTTTTT TTTTGAGGA GTCTCTCT GTCTCCCAGG CTGGAGGGA GTGGCGCGAT
29461 CTCGGCTCAC TGCAATCTCT GCTTCGGGC TAGCTGGGCC TACAGGTGCA GACCACCACG
29521 CCCGGCTAAG TTTTGTATTT TTTTTGGTAG AGGGGGTTTC ACCATTTTGG CCAGGCTGGT
29581 CTCGGATTCT TGATCTCAAG TGATACACTA GCTTTGGCCT CCCAAAGTGC TGGGATTACA
29641 GTCGTGAGCC ACTGCGCCCA GCAAAATGCT TTTTGTGGAG CCAATCACTT TATTAGCGCT
29701 TACCTCTCTA TGCCTACTTT ATGCTTTGAA ATTTTGTCAC AGTGGGGCCG GTCATGGCAA
29761 ACACAATTCA TTCTTATGCA GGCTGTCACG GTTATTTCTG TCATCCAAAC TCATTCTCGC
29821 AACGCATTTC AGCTCTTTAA ACGACTTTGT GAGCGGCCCT GAAAAGGGCC TTTGGGTTTT
29881 TTTGTTTTG TTTTTTGAAG TTCTCAGGAG ACCGCGTATT CTTAGATTCA GCCGCCGAAG
29941 CCATACAGAG TGCGCCCTG ACGTTTCAGG GCATATACTA CATCCATGGC TGTGACAGTT
30001 TTGCGCTTGG CGTGCTCCGT ATAGGTGACG GCGTCTCGAA TAACGTTCTC TAAGAAAACC
30061 TTAAGCACAC CTCGAGTCTC CTCATAGATA AGACCGGAAA TGCGCTTGAC GCCACCGCGC
30121 CGAGCCAAAC GGCGGATAGC CGGTTTTGTA ATGCCCTGGA TGTTATCCCG GAGCACCTTA
30181 CGATGGCGCT TAGCACCACC CTTCCCCAAG CCTTTTCCGC CTTTGCCGCG ACCAGACATG
30241 ATTCCTATCG CAGTGGAAGG TATGAACTGA AACAGTTCCT TAAATACAAA CTTGGCGGAC
30301 CTGATTGAAA ACAACATGAG TTGGCGCGGT TTTTTTTTTT TTTCAAATTT GGTCACCGAG
30361 TGGGTGGAGC AAGAAAAACT GTTTCATTAT GGTTCATTGT TTTGATTGGC CAGTGACAGC
30421 TTGCTCTTTG TGGGAGTGGA AGGGTGTTTG CAAGTTGAAT GCGCTGTATT CCTGTCAGCT
30481 TAATGACGCT AAGCATAGCC CCATTCCACA TTTCTTTTA TTTCCACTTG CTAACTAATA
30541 AATTACGGAA TAGTTTATTG GGGAACATAC AAATAATGTT TAAAGGAGGT CAGATTTATA
30601 GGTCAAGGGA TTTACCCTCC CAATCATTTT AATATTTTA TTTAAACCAG GCATTTTGAT
30661 GGCCTTCTCT GTGCTGGACA AGGTATAAGT TTGGCTATGA AGTTTCACTC CTAAAGACCC
30721 TATGTTTTGG GAAGGCAAAA AGGTAGCCAA ATAATTGCAA ATTAAAACCT CATAAGTGCA
30781 AACTTCTTCC TCGTCACTTT CCCTATCTCG ATTCAAATAT TTGTTGAATG ACTCATTTTT
30841 CTGCAAAAGT CTGAGAGAGA CAGGGAATAT AAACTTAAGT CTGGATAATA TGTTTTCCCG
30901 GGACGCTCTT CCTGGTCTGC TGTGCCTGTT TGCTGTGCCT GAAATTCCAA ACACTCTTCC
30961 CTTCCCTCCG TTTTTAATCC CCTTTCAACT TGCTACAGCT TTAGAGAAAA GAACATACGT
31021 TTTGTACAGT TGGGGATTAA TTGAAGTGTA GGGCTAATAC TTGATTAAGG TCATTACAAA
31081 ATCTACAGGG TCTTCCTCTG GGAGGTTTTT GTGATAAGAT TATTGGTGTT AAAATAAGGC
31141 TAATCCCCTT GAAAATAAA TAGAATAGCA GAATTGGGTC TGAATGTGGT TTGAAGAAAG
31201 GGACTTCTCA ATTCAAAATT TTATTCTTAG CTTCCTGTGG GAGCTTTCCA GAATGCCCAT
31261 AAGATCCACT TTTGTTTAAA AAACAAAAAC AACCCCACCC ACCACTCTCT GGTTAATAAA
31321 TGAATTTCTA TTGGGAATAT TTAGAATGGG GCTGTGGCCT GTGAGAGACA TTATATAGTA
31381 ACCTCAGACT TGCTCACATG AAGAGAAGAA ATCCAGGAAT GGAGAAAAA GACCCAGGAA
31441 AGGCCAGAAT GCTCTACATG TCATATTGTT TGTATCACTT CTGAAATAAT TGATTACATT
31501 CTTCTGCCCC AAATTGAGTT CTTAGGTTCT TCCACTCACT GTCCACATGC CACAACACAG
31561 ACCTTATAAC TAGAGACTTA GCTAGGAAGA AATGTCAAAC ATTACAGAGA AAAAATGCAG
31621 AGTCTGAGAT CATAAGTAAA ACTCTGAAAT CTCAACATGC CTTTTAATTC ATGAAAATAA
31681 AAAATATAGC AGCATATGCA ATATGATAAT TCTCTGAAAA CATACATCAT GTGAACTACC
31741 CTGGAACACA TCTCGCCAAG TGCCATCTTC ATTTTAACCA GAGGTCTAGG ATGCCTTTCC
31801 TTTATTTTGC CTATTATATC ATTTATAAAA CCCCATTTTT ATTTTGATAT TTATTTACT
31861 TTCTATTTCC TGCTCCTAAT ATCTCCTTTC TAAACTTTTC TCAATGACAG TGACTCAAAA
31921 ACAATGAATG TCAGAACAAA TATTTAAAGG ATCTGTACAT GTAGATATAT ATATTTAAAA
31981 TGGATTCTTC CACTCTGGGA AGAATTCAGG CATACTCAAT CTTATGGTTA GGGAGAGATT
32041 AGGCTCACTC GCCTAATCTG TATGGCTTCT CGTTCGCTTT CCATTTCACC TTCCTCTCAC
32101 CCATCAGATC AAACTCATTC ATTGAACAAG AGACCTAAGC CCTTCAGATT AAAACTCTGC
32161 AAACAAGTTG TGGTTGAGAG GATACATGAA GCATTCAAAC AAATAAATCT ATGATATTAA
32221 TCAGAGGTTA ATCTATGATA TTAATCAGAG GTTAATGCAG TGGCTCACGG CTGTAATCCC
```

Figure 2 (Page 10 of 74)

```
32281 AGCACTTCAG GAGGCTGAGT TGGGAGAATC GCTTGAGCTC AGGAGTTCAA GACCATTTTG
32341 GGCAACATAG CAAGTCTTCA TCTCTACTTA AAAAAAAATA ACCAGAGGTG TTATGAAAAT
32401 ATAAATTGTC CAGAACTACC CTCCACAAAC TAACTCTCTC AGAATATTCG ATATGAGGAA
32461 TGAAATATGG TGTGTGTGTG TGTGTGTGTG TATGTGTGTG TGTGTGTGTG TGTATGCACC
32521 TATATATGGC ACCTATATAT TCAACAAACA ATTCTGATAA TTGGCCAGGG TTGAGAATGA
32581 CTAGCAGCCC AGCATACACT ATCAGTTTTA AGTATATAAT TGCGCTTTAG TAAAATGTAA
32641 AGAAATCCCA GAGTAGAAAT ACTTTTAAGC TATATTACAG GTGAGAAAAT GCATAAGTAT
32701 AGTCTCACCC AACTTAGACT ATGGGGGCTT TATAATGTCA CAACAGTTGT TTCCAGGCAT
32761 TTGGGGACAT CACCACTGGT CTTGGGCAAG AAACTCCTCT AGCCAATGGC TGATTTATCT
32821 CACTCCCATC TAAGGCTTCA CTGCATTTCT CTTTTTCAGC AACCTAACTT ATTTAAAAAT
32881 ATCCATTTTC TGATTCATTT TTTTCTGAAT TAAACTGTCA GTACCATTGG CACACCTTTG
32941 GTTCCGTAGC ATACCTGTGT CTCTGCTGTG GTTTTTTTA CCTCCACTCC TTACTTTTCT
33001 AGAAAAAAAT CTCTGCTTTT TCTTTTCAGT TTAAATTATT TCACAAAAAG TTTTCTTGAC
33061 TTGCACTTCC TAGGCTTGCT GTCCTTGTGT GGGCACGCTC CCATAAACAC TATTAATACA
33121 CTTCGATTTG TTAAAAATAA AGATATCTGG ACAGAAAATT TCTTTTCTTT TTTTAAGATT
33181 TTAAAATTTT TAATGTTTAT TTTTTTCCTA GACTGGAGTA CAGTGGCACC ATGATGGCTC
33241 ATGGTAGCCT ACACTTCCCC GGGCTCAAGT GATCCTCCCA CCTCAGCCTC CAAGTAGCT
33301 GGGACTACAG GTGTGCACAA CCACACCTGA CTAATTTTGT TTATTTGTTT GTTTTGTTTT
33361 TTGAGATGGA GTTTCGCTCT TGTTGCCCAG GCTGGAGTGC AATGGCGGGA TCTCGGCTCA
33421 CCGCAACCTC TACCTCCCAG GTTCAAGCAA TTCTCCTGCC TCAGCCTCCC GAGTAGCTGG
33481 GATTACAGGC ATGCATCACC ACGCCCAGCT AATTTTGTAT TTTTAGTAGA GACGGGGTTT
33541 CTCCATGTTG AGGCTGGTCT GGAACTCCTG ACCTCAGGTG ATCTGCCCGC CTCGGCCTCC
33601 CAAAGTGCTG GGATTACAGG CGTGAGCCAC CACGCTCGGC CACTAATTTT GTATATTTTG
33661 TAGAGATGGG CTTTCCCTGT GTTGTCCAGG CTGGTCTTGA ATTCCTGGGC TTAAGTGATC
33721 TGCCCACCTT GTCCTCCCAA AATGCTAGGA TTACTGGCGT GAGCCACCAG GTCTGGCTGG
33781 AAAGATAATT TCTAACATTA TCCTCTCTTA AACATTTGTT TCAAAAATTT TACAAACATG
33841 AGAGTAATTA AATTTGATTT TCAAAATTCC CTTGAATACT TTCTTAATAG CACACAGAAA
33901 GCACAAAGTA TTTTACATTT GTTTTAATGA TGAAATTGTG AACCCAAACT TACACAAAGA
33961 AAAACCGTAA CATTATACCC ATACTTAAAA CAGATGCCCT CATATACATA GTAAAACTCT
34021 TGGGGCAGT AGTGAAGTTG GTTATTTACT GTTTATGAA AGTGCCATTC AGCCGGGTGC
34081 AGTGGCTCAT GACTGTAATC CCAGCACTTT GGGAGGTCGA GGCAGGCTGA TCACGAGGTC
34141 AGGAGTTCAA GACCAGCCTG ACCAAAATGA TGAAACCCTG TCTCTACTAA AAATACAAAC
34201 ATTAGCTGGG CGTGGTGGTG TGTGCCTGTA GTCCCAGCTA CTCAGGAGGC TGGGGCAGGA
34261 GAATCGCTTG AACCTGGGAG GCGGAGATTG CAGTGAGCCG AGATCGCACC ACCGCACTCC
34321 AGCCTGGGAG ACAGGGCGAG CTCCGTCTCG AAAAAAAAAA ACAAAAAAGT GCCGTCATAG
34381 TGACTTAGTT TTAAGGAATA AATCAAGGAT ATTTAACTCA ATAGACTACA GTTAGCTAAC
34441 GTGACTTGCA CTGAAAGTTA TACGAATATT GGTACTTATT CCCCTGCCCC TGAAGTATGA
34501 ATTAAAGACT CCAAAATTCT TTTTAGAATC TTCAGAGTAA AAGCTAGAAT TTGATTTTTT
34561 TAAATAATAA AAAAATACTT TGTATCTAAA TCTGGTGTAT AAAATAACTT GGTGGATGAT
34621 GCTTCAAGGC TATCCATCCC CAAATTTCTC CCTGAATGAT AAAGAGAATA AATGAATATG
34681 TCAATTCAAA AGTTAGAAAT TTGGCCGGGC ACGGTGGCTC ACTCCTGATA ATCCTTTCGG
34741 ACGCTGAGGT GGGTGGATCG CATGAGCTCC GGAGTTCAAG ACCAACCTGG CAACATAGC
34801 CAGAACCCGT TTCAATAAAT AATAGAAAAA AATGAGCCAG GCGTGGTGGT CCCAGCTACT
34861 CAGTAGGCTG AGGTGGGAGG ATCACTTGAG CTCAGGAGGT CGAGACTGCA GTGAGCCGTG
34921 ATCGCAGTAC TGCACACCAG CCTTGGTGTC AGACTGAGAC CCTGTCTCAA CAACAACAAA
34981 ACAAGTTAGA AATTTGGCTG GGCGCGGTAG CTCACGCCTG TAATCCCAGC ACTTTGGGAG
35041 GCCAAAAGG GCGGATCATT TGAGGTCAGG AGTTCGAGAC CAGCCTGGCC AACATGGTGA
35101 AACTCCATCT CTACTAAAAA TACAAAAAAA CTTAGCCGTG CATGGTGGCA TGCGCCTGTA
35161 GTCTCAGCCA CTTGGGAGGC TGAGGCAGGA AAATTGCTTG AACCCAGGAG GCAGAGGTTG
35221 CAGTGAGCCG AGATCATGCC ACTGCATTCC AGCCTGGGTG ATAGAGTGAG ACTCCATCTC
35281 GAGAAAAAAA AAAAAATTCT GTATGAACTG AACAAATAT CCTTAAATTT TAAATACAT
35341 CTGAAAGATA TTTCAAAATA TTTAGGAAAA AAATTATAGG GATCAGGCAA ATTCTGAGAT
35401 TCCTTTTTCC CTGCAGCAAA CATTAGGAGT GCTGCTGTTC CTAAAAACAT GGTAACTGTT
35461 GCCACACCGT ATGTTTCCTT GGCTCAGACA TAAGGTTGTG TAGTTGTTAT TCCAGAATAG
```

```
35521 CTAGAATAAA AATCCAGCAC ATCATTTTCT TCAGCAAGTT AACTAACCTC TCTGTGCCTT
35581 GGTTTCATAA CAGCAACATA AGCATAACAG AATAGCAGCA ATAGCTCCTA CCTACCTCAT
35641 AAGATTCTTT GGAAGAATTA AATTAAGATT CAGAACACAG CCTAATATCT AGTAAGTAAT
35701 AATAATTGGC TAAAAAAATT TTCTTAAGAT TATATATATT CATGGGGTAC AAGTACAATT
35761 TTGCTACATT AATATATTGC ATTGTGGTGA AATCAGGGCC TTCAATCCAT CCCGGAAAAA
35821 AAAAGTTTTT GAAAAGATTT CTGCCATGGA AACTTTTAA TGTACAAATT CATCCATCCA
35881 AGAAATAGAA AATATATAAG TATCAACTCC AAATCCACCA TATCTATCTC TTCTGCACCT
35941 TAAACAATTA CTCAGAAATA GAATGCTTGA GATACCAGAA TGCATGCATA TCAAGTAATA
36001 AATGCATGCA GGATGTCAAC GCATCCTAGG CTTTCAAATA AAATTGTCAT ACAAAATACT
36061 TTAATATTGT AGTAACATTC TACATGTTAG AGTGTAGAAG TTAATCGCTG ATCCAAAAAA
36121 GGAAAAGAAC ACATTATACC CAAAGCCTAC AGAGAGAATC ACAATTACAA ATATCAGCCT
36181 GCATGTGAAA ATCTTTAATT TGAAAGTCAG AAATATTTAA ATGATAGTCA TTGTTAAATC
36241 AGATTGTGGT TTGAAAAAAA GTTAGTTTAA AACTGAGTTT ATGAAAAATT TGGGGATTTT
36301 AGAGACAGTG TTTTGTTTTT AAATGTGTGT GAGTTTGTGA AGAATGTTTT ATAAAATACT
36361 GACAGTATTA TAAGATGACA TTATTATAAT ACAACATAAG AATTTTGGCC TGTACCTCTC
36421 AGCAGTCCTC AATCACCTGC TGTACTTGAC TCAATGATTA TCAGAGTGGT TTGTTTTCCT
36481 TCTGTTGTGT TCCCAGTTCA GGCAGCTCAG CAATGGCCTG TGATTCCAGC AATTCAAATA
36541 GCTGGTAAGT AGTTTCTTGT TTGTTTTCTC AAATTTTCAG GGGCTTTTCT CTACAAGTGA
36601 TTTCCAGTGC ACGCCCCTCC ACCCATTCTT TATTCCTTTA CCTTCAGGAA AACCCTCAGC
36661 GCTGCATCTC TGGTCACCGG ACCACCGTGG TACATTTACC TATGGCCACC AGGTGTCACC
36721 CTTCTCTTTA CTACCATGGT TTGTGAATGG TTTTGCCAGA GGTGAATAAG AATTTAAAT
36781 GCAGGTCTTT GATTTTCAA ATGTAGTTGA CCTTAAGAAT TTATGAATAA AGCCAGAAAA
36841 ATTAAGCTTA AAAACACCG AAAGAAATG AGGACTAAA ATTTCTATTA AAAAATTAA
36901 CAGGCCACAG TTGCTGATGT TTAGTAAATG TGTTAGTGAA ATGTGTTACT GTGAAGACTG
36961 GGGTGTTTCT TGAAATCTCA GCCCAGGTGA AATAAAACCA ATATAAAACA AATGCTTACC
37021 TAATAAATTA ATTGTAACAT ATTCCTTATG AGGTAGAAGA GTAAGTGAAG CCTTATAGCA
37081 GTCTGCTTTC AGTATAGTAA GATATTAAGA GAGAAATAAT TTGTCATATG CTTTCAGAAT
37141 GGTTTGCTGG TAAAATAACC AATGTCTTAC AACTTAGACG ACAATGTCCC TAGAGTGAAG
37201 AAACACGATT AATTCGGCTA CCACAGTTGA ATGAAAATAT TCCGTAAGAC AAAATGTAAA
37261 GAAATTAGAA GCAAAATAAA TGTCTCCAAA ATGACAAAGC GATTAAGTAT ATACACAAGA
37321 TGAACAAGAA CTTCAATAAA ATCATGCAGT ATACAATACA ATGTACATTT ATTAAAGTAT
37381 ATGCATTTTT AATGCAACAA TAATACTAAC AGGTAATAGA CAAGTTGTTA ATAGTTTTTC
37441 ACTGGCTAAT TAAATAACAG CTTTAATTGT ATTCATTTTA TAGCTTTTCT ACAATGAGCG
37501 TAAATCACAT TTACTTTTTT CTACATAACT TTTCTAACCA CAAAAAAAGA AAATGGTTTA
37561 AAAGAAGAGA TGAGATATCT TTGCTAAAAT TTAATGCCTA AAGAAGAAAC TTCTGAGCTG
37621 TATATGGTAT CCTGAAGCAC CTGCCCTTCA AGACAGAATG CTTGTACCAC ATTTATGCAG
37681 CCAAGTGCAT GTAGTAACAT AAAGTAAACA CATGCCATCT GGATATATAT ATTAAGACTC
37741 TTTTGACGGC TGGGCAGGGT GGCTCACACC TGTAATCTCA GCACTTTGGG AGGCCGAGGC
37801 AGGCGGATCA CGAGGTCAGG AGAGTTCGAG ACCAGCCTGG CCAACATGGT GAAACCCTGT
37861 CTCTACTAAA AATACAAAAA TTAGCCGGGC ATGGTGGTGC ACGCCTGTAA TCCCAGCTAC
37921 TTGGGAGGCT GAGACAGGAG AATCGCTTGA ACCTGGGAGG CAGAGGTTAC AGTGAGCCGA
37981 GATCATGCCA TTGCACTCCA GCCTGGGCAA TAGAGTCTCA AAAAAAAAAA AAAGACTCTT
38041 TTGAACATGG TGAACTGATT TCCCAGAATC TAGCAATTCC TGAATGTCCT GGTTAGATTT
38101 TTTTTTTAAT GTGCACCGGA ACCCAGTGG CTCCATGGAA GGACCTGGGC ATCCTCTAAG
38161 CCACTTGGTG GCTTCCATTA TACCATCTCA AAATGAGAGA GCTTACTCCA CTTCATTGAG
38221 GGAAATACCA CCAGAGTTCT GACTCCAGAG GCACTGGCCT AGGGAGGACA CCGTGTGTGA
38281 AGCCCAGCAG GGCCACTAGC TGTCCCCACC AATTACAGTC CTTGCGTAGG GTCCAAAGAA
38341 ATGAATGCCA AAGAGAGCAA CAGAGGAGCA AGGGAGTCAC ATTCCAGGAC CTTCCTTCAG
38401 GGACTTTTAA AGGAAACATG ACAGCTGAGG ATCAGTTGGT TGTTTCTGC TGTTCCCCTT
38461 CATGTGATTC AAGCTCATTC AGAAGAAACA CAATGAGACA AGAGAAGAGC CATCTCCTTC
38521 CTTCTCTATT TATTCTAGGC ATCTAAACTA CTGAATGTAG TGGTGTCTGA GATGTATCAA
38581 ACGGTCAGAT TGACTGAGTT TGAAACCTGT TTCTATCACT GACAAACTAT GAGATACTCT
38641 ATACTTCACT TTCTTTTTTT TTTCATTTTT TTATTTTTAT TTTTATTTTT TTGAGATGGA
38701 GTCTCACTCT GTCACCTAGG CTGGAGTGCA GTGGCGCAAA CTCGGCTCAC TGCAAGCTCT
```

Figure 2 (Page 12 of 74)

```
38761 GCCTCCTGGG TTCATGCCAT TCTCCTGCCT CAGCCTTCCG AGTAGCTGGG ACTACAGGCG
38821 TCTGCCACCA CGCCCAGCTA ATTTTTTGTA TTTTTATTAG AGATGGGGTT TCACCATGTT
38881 AGCCAGGATG GTCTCGATCT CCTGACCTCG TGATCCACCC GCTTTGGCCT CCCAAAGTGC
38941 TGGGATTACA GGCGTGAGCC ACCGTGCCCG GCCTACTTCA CTTTCTTCAT TTAAAAAAGA
39001 AATGGGGATA ATAGTACCTA TCTCATAGAA TTATTGTAAG AAGTGCATGC AGTAATGCAT
39061 GTAAGTAGGT GCTCAGAAGA GTCGGACACG AAGTAAGTGC TTTTATCATC CTTATCATAA
39121 TTTTCATTAT CAGAACAAGG AGAGACCAGG TAGAAAATTA TTGTGATTCT TCAGGTCTGG
39181 AATACTAGAG TAGCATCCCA AATGAAGGCA CCATTAAACT TTGCAAATCT GTATGACACC
39241 TTCATGCCAA TTAGAAAAAA CACCTCTTCA CAACCCCTTT CAAGATATTT GCCTCCTACC
39301 TGCTAAAAAC ACCCATCATA CTACCCACAG ATAGCCATGA TGCTTTTTCT GGGACAGGTG
39361 CCTCTTCCAT TCGTGCAGTG TACAGCCTTC ATAGCTGTGC AACTCACATC ACAATCAGAT
39421 GGAAGAATCC CCAAGGCTTG GTGACAGATG AGTTACTGGG TAACACAGAG AGAGGATTCA
39481 AAGGAAAAGT TGAACGGGTC CAGAAAATGC ATAGATACAT GTGTAAAAAT CTGGTAAGGT
39541 TATGACTAGC CACGTCCCAG GGTTCAAAGC TTTTCTCAGA TGTTAAAATG AATCATGTAA
39601 GTCCCCCAAA TTTAAGGAGT CCTCTTCCAA AAATAGGAAA TGAAATGACA TAGGTGTATG
39661 TCTCTGAGGT GACGGAGGAA ATGAAGGAAG CCTCTAGATG CAGCTTGAGG TTCATGAGAG
39721 ACAGTTCCAG GGGAGAGGTC ACAGCTAGGG ATCACCGGCA TGCAGGAACT CAGAAACCTA
39781 AATGGGGAAA TCTTTTTGAG GAAATGAACA GAGAAGGCTA AAATCAAGGA GTTCGTCAGG
39841 CAATTTCTAT GTTTAGGTTC AACTCTCTCC TGAAACATGA AGAGCTCATA AATGCACTCC
39901 CTCTTTGAGT CTCTAGTTTT GTCTCCTTCC CACAGTGAGT CTGCAGGCTG CGTGTCACTC
39961 ACGTTCAGCT AAGACGTAGT GCCCCATGGC TCCTCCTGTG GAGACAAGAG ACCCAGGAAA
40021 GAGGCATCAC AAACCTAGGC ACCATCTTGC CTCTTCTCTC TTCCTTATTT TCCTCATTCA
40081 CCCATCTCAA TTTAGACCTG GCACTATTG GATTTCAAGA ACCATTATCT CTCATCTGGA
40141 AATGCTTATT GGCTTTCTAA CTGGTCTCCT CACCTCTCAT CTAACTTCTT AACAACACAT
40201 TCACCATATA AGGGAGATCG TGGTCCTCCT TTCTTAGGAT CCTTCAATGA CACCCCAGTG
40261 ATCATAACCC AATATCCCAA AAGACCCTTG GACTCTGTAT GAGCTGGCTT CTTTCTGATT
40321 CTCTTTTCCC TACACCACAG ATGTTCAGGG GGTAGAAATG CATAATTGGT GAGTGATAGC
40381 TAAGCAAACT CAGGGTTAAG GTACAGTAAT TATTTCTAAT CTCCCAGTAT GCCTTATACT
40441 CTCCTACTTG GCATGGTTGC TCCGTCTGTG TAGACCTCCC ATCATCTTCA ACCTCACCTA
40501 ATGGAATCCA GCTTCTCCTT CAAGATCCAG AAGGCTATCT TGATCCCCAG CTGAATGTGA
40561 TCATTCTTTC CTTTGACACC CTAAGCATTT GCTTCCTGCC TGCTTTAGGA CCTCATGGGG
40621 TCTTCTTTAA CTACATTTAC TTGCTATCAA TTTCATTCCC TACCAGATTT GGGTTCTGAG
40681 AATAGCCACA GTGACTTCTC AACCTCAAAG CCCCTGTACT ACCTTAAACA GCTCTTGCAA
40741 AATAGTAGGT GCTCTGAAGA TGTTTGTTGA ATTAGAGACT TTCATTCTGG GGAGAACCAT
40801 TATTTTCTGT CTCCCAGGGA GCTGCTGGTG TCCCCAAAGA ATATAAATGA GAAAAATGCT
40861 TCCCATGGAT GCCAGATCCC CTCTGCCCCT CTTCCCACTG TGCCCTGGGG CAGAGGTACT
40921 AAGAGACTTC CCCCTTGTTC CTACTCACTT GAACCCTGCC TCTTCCTTAA TATTATGAAC
40981 AAAATTCCAA TGAACAAGAT GACGACAAAA ACAGCAATTC CACTGATGAC TCCAATGACT
41041 AGGGTGCCAG ACGGTGAGGG CTCTAAAACA GAAAAAGCAA GTTAAAGCCT TTGATTGCCA
41101 CCCTCAGCCC ACCCCCTAAC AAAGAGCAGA TCCTCATCTC ACTGCCATAA TTACCTCCTC
41161 AGGCACTCCT CTCAACCCCC AATAGATTTT CTCAGCTCCT GGCTCTCATC AGTCACATAC
41221 CCCAGATCAC AATGAGGGGC TGATCCAGGC CTGGGTGCTC CACCTGGTAC GTATATCTCT
41281 GCTCTTCCCC AGGGGGTACA GCCAAGGTTA TCCAGCCCTG GTAGGTCCCA TCCCCATTGG
41341 GCAATACGTC TTTAGGTTCG AACTCCTTGG CATCCATTGG CTGCTTATCC TTCAGCCACT
41401 TCATGGTGAT GTTCTGGGGG TAGTAGTTCA AGGCCCGACA CCGTAGAGTG GTCACTGAAG
41461 AGGTCACATG ATGTGTCACC TTCACCAAAG GAGGCACTTG ACAGGAAAGA GGAAGGATGA
41521 GGAGAGGGGA TCTGTTTACC CTTGCCAGGA AGACTGGAAC TTTCACTTCC TTCTATAGGT
41581 TGGAGGAAGG AAATACCCTT TTCAGAAAAA AACAAGCTAC AGGAGAGACA CCATTTTGTG
41641 TCCTAAGATT GGACTCTAAC ACAGTGTCAC TTGGAGAGCA GTCAGATCAG CTTGTTCTCC
41701 TCACATGTAA ATATACATAT CTGTTACCCA TGTTCTTTGT TCTGATAGAT AAAATTGCCC
41761 TTTATGTGCA TTGAAAATGA TTGAATACAG ATGGTCAGTT TCACCTGGGT CAACCTAGGA
41821 GGCATTGTTA TAAGAAGCGG ACTTGTAAGA TAGGTAGCTT CAGTGATTAT TGCTATGTTC
41881 TATGAAAGAA ACTTTTAACC TAAAGGATTC TTCTACTCTG ATAAGTGGCC TCACTTGATA
41941 TTTTGTCCTG GTATTCATAT GATAGCTGAG ATCTCTGAAT TCTCTTTTTT TTTTTTTTTT
```

Figure 2 (Page 13 of 74)

```
42001 TTTTTAAGAT GGAGTCTCAC TCTGCTGCCT AGGCTGGAGT GCAGTGGCGC GATCTTGGCT
42061 CAGTGCAACT TCCGCTTCCC AGGTTCAAGC GATGCTCCTG CCTCAGCCTT CCAATTAGCT
42121 GGGACTACAG GTGCGCATGA CTGTGACCAG CTAATTTTTG TATTTTTTTA GAGACGGGTT
42181 TCACCATGTT GGTCAGGCTG GTCTCAAACT CCTGACCTTG TGACCACCCG CCTCGGCCTC
42241 CCAAAGTGCT GGGATTACAG GGGTGAGCCA CCGTGCCCGG CCTTGACATT TCTGAATTTT
42301 TAACAGGTAT AAATATACAA AAGATTATTG GTTAAATAAA AAGCAAGGGC CATAGACACT
42361 TCCCTTTGAG CCATATGCAT GGAGAAAAGA AATTAAACCC ATGACTTGTG GCTGTCTCAT
42421 ACATCTCAAT TATAAGGTAG AGACTCTAGG ATTGAGAAAG TCCCTTCCCA GAATTTGGAG
42481 AGGCACACAG CCTCAGCCAC CTCTGAAACT CCAACCAGGG ATTCCGTGCC CTGCAACCTC
42541 CTCCACTCTG CCACTAGAGT ATAGGGGCAG AAGTGTGTTT CCACCATACC TTGTTGGTCC
42601 AAAACACCTC TCCCCAGCTC CAGCAACTGC TGCAGCTGTG CAGGGCAGTC CCTCTCCAGG
42661 TAGGCCCTGT TCTGCCTGGC CCGAATCTTG TGCCTTTCCC ACTCCAGCTT GGTGGGCCAG
42721 GCCCTGGGTT CTGCTGCTCT CCAATCCAGT GTGTCAGGGC AGAATTCAAG GTGGTCCTGC
42781 CCATCATACC CGTACTTCCA GTAGCCCTCG GTACTGTTGT CTTCTTGCAT TTCACAGCCC
42841 AGGATGACCT GCAGGGTGTG GGACTCTGGA AAAATCCCCA GCCTTGTTAA CTGCAACCAA
42901 AGGAATAGGT CCCTATTTCC ACCATCCCCA AGGACCAAAT GATCTCAGGA AGCAAATTCC
42961 TTCCCTCTTC CCTGCTCCCA CAAGACCTCA GACTTCCAGC TGTTTCCTTC AAGATGCATG
43021 AAAAGATGAA AAGCTCTGAC AACCTCAGGA AGGTGAGGCC CCCTCTCCAC ATACCCTTGC
43081 TGTGGTTGTG ATTTTCCATA ATAGTCCAGA AGTCAACAGT GAACATGTGA TCCCACCCTT
43141 TCAGACTCTG ACTCAGCTGC AGCCACATCT GGCTTGAAAT TCTACTGGAA ACCCATGGAG
43201 TTCGGGGCTC CACACGGCGA CTCTCATGAT CATAGAACAC GAACAGCTGG TCATCCACGT
43261 AGCCCAAAGC TTCAAACAAG GAAAGACCAA GGTCCTGCTC TGAGGCACCC ATGAAGAGGT
43321 AGTGCAGAGA GTGTGAACCT GGAGACAGAG CAACAGGCCT TAACCATGTG TAGTAGGAGG
43381 GGAGCAGGAT GTTGAGGCTC CACACACCTG CATCAACTCA TACCATCAGC TGTGTCTGGT
43441 CCTCATTTTG TGAAGGGTGA GTTGCAGTCC TGTCTTTCTT CCATATGACA GTCCTGGGTG
43501 CTCTTTCCTT GTGTGCTTTT CTCTGCCACA CGTGGCTGCC ACCCCTCAC TGCCCCAGA
43561 TCCTATTCCA ATACTCATGA TTAGACAGAC TCCACTAAAG CTGGTGGATT CTAGAAAATG
43621 TTAAGGTGTG TCTAGCCATG GTAGTTGAAC TCAGGAGTTG GTGCTCAGGG CAAATTAGAC
43681 CCAAATCCTG AGGAATAATT CCTTCAGTTT TTTTTTTTTT TTTTTTTTTT TTTTTTTTTT
43741 GAGACAGAGT CTCACTCTAT CACCCAGGCT GGAGTGCAGT GGCACAATCT CAGCTCACTG
43801 CAACCTGCAC CTCCTGGGTT CAAGGGATTC TCCTACCTAA GCCTCCTGAA AACCTGGGAC
43861 TATAGGCGTG CGCCACCACA CCAGGCTAAT TTTTGTATTT TTAGTAGACA TGGGGTTTCA
43921 CCATGTTGGC CAAGCTTGTC TCAAACTCCT GACCTCAAAT GATCTACCTG CCTCAGCCAC
43981 CAAAGTGCTG GGATTACAGA AGTGAGCCAC CGTGCCCAGC CTTGGTCCTG AATTCTTACA
44041 CTGAACTGCC TATGTGGCCT CACCACTTGG AAGCCTGACT GGAATCTCAA ACTTAACATG
44101 TCCAAATGCA GATCCTTGAT TTACCCCAAA CTGCTCTTTC CTCTGCCTTC ACCATCTCAG
44161 AAATGGCATT GCCAATTACC CCACTGCTCA GGCCAATAAA ATTAAAATAA AGAACAAAGT
44221 CAACTTTAAC TCTTCTCTTT TTCAGGGGGT CAGGGGAGAC AGGGTCTTGC TCTGTCACCT
44281 AGGCTGAAGT ACAGTGGCAC AGTCATGGCT CACTGCAGCC TCAACTTCCT GGGCTCAAGC
44341 AATACCCTCC ACCTCAGCCT CCCGAGTAGC TAGGATCACA GGTGCATGCC ACCACACCCA
44401 GCTAATTTTT GTATTTTTTG TAGAGAAGGG GTTTTGCTGT GTTGCCCAGG CTGGTCTTGA
44461 ACTCCTGAGC TCAGGAATCT GCTCTCCTTG GCCTCCTCCT TGGCATGAGC TACTACACCC
44521 AGCCAATTCT TCTCTTTCTC TCACACAACA TAGAATCCTT CAGCAACTTC CTTCAGAATA
44581 TATTCAGGAG ACAATGGTTT GTCACTCCCT TTTCTGTTCC CACCCAGCCC ACTCCACTAC
44641 CTCTTGCCTG GACTGTGTAA CAGCTTCCTG GCTGGGCTCC CTGCTTTTAC TGTTGCTCCC
44701 TTCATTCTGC TTTCCACATA GCAGCCAGAG CAATCTTTTA AAAGCCTGTG ACAGATCACT
44761 GTTACTCCTT GGCTAGAATT CACACCACAG CCTACAGGCG CCTGCACAAC CTTGTTTGTG
44821 GCTCCTCTTC TGAGCCCATT ACCTACTTCT TGGCCTCTAC TCCCCAGCAC TACTTGTTTA
44881 TTTTTTTCAA CCCGAGCTTC TTAACCAGGA GTTTGTCTAC TAGGTGACAT GTGGCAAAGT
44941 TTAGAGACAT TTTTGGTTGT CAAGACTGGG GGAGTGCTCC TAGCACCTAG TGAGTAGGGA
45001 GGACAGGATA CTGCTAGACA TCCTACATGC AGATGGTAGT CCCCCTTCCC ACCCCCACGC
45061 CGCCCCCCCC CCCACACACA CACACATGAG TAGTGCTGAG AAAACCCGCT TTTAATCCA
45121 ACTTGCCAGG CCCACTCAGT TTGCCTGGGA AATACTGCTC CCAGTCAATA TCATTCTTAT
45181 TTCCTTCATG TCTCTGCTCA AGTGTCAGCC CCAGAGTGAC TTGCCCTGAC TTCTCTGCTT
```

```
45241 CTCACAACAC CCATGATTTC CTGATGTTGT ATATCTTTCT GCTCATTTGC TTATTGTCAT
45301 CTCTCCCACT AGAATGCAAA ATATCAAAGG GTAAAGACTT GTTTCCCTGC TCTCTCCCTT
45361 GGGGCTTGAA CAGTGCAACA CATGGCTGGG ACTCATTTAC ACTTGTAAAC AATGAATATT
45421 TCTGCTCAAC ATGAAATTTT ATTATTCAAC CTCTAATGCA GTGTGATGTT TAAGAATCAT
45481 AGCTATGAAG TGGAGACATG AGCTCTGCCA CCAAAGCCCC GTGTACCATT GAATAAATTT
45541 GCCAGGAAGC AGGCCGTGCC ATGCCTCATT CTTGTCATGT GTAAAATGTG GATACACGTA
45601 GTACCAAAAC TCAAAGTGCT GTGCTGAGGC CGGCGTGTGA CCCACAGAAC ACTGTGCTAC
45661 ACTACAGGGC AAAATCACTG TCAACTAAGA TTAGAAGCAG CTGTAGTACT TGAAATAACA
45721 TCAGAAAACC AGATTATTTA TGTTCTTTGT AACCTGAAAA GAGTTATATA ATCTGAATTC
45781 CAGTTAACTT CTAGTAAAAT AAACGTATTA TTAGCTCCTA CCTCCCTATG CCTAGTGAAA
45841 ATCAAATAAG ATCAGATATG AATGTAACTT AGAAGTGAGT GCATTGCTTA CATGTTCATT
45901 ATCAGTACTT TGTAGAGAGG CCTCTTAATT ACACAGCACA TTGCAAATCA ATAAAGCCTA
45961 GCCGAAAAGA GAATTGTTCA GTTCAAACGT TCAAAACTAA CATATACTTA ATTTTCCAGG
46021 CAAAAGAACA ATTGCCAAGA GTGGGGAAAG GCCCGAGGTA GGCCTCTCTC AGGAGCCTCC
46081 CACCCTAGAG ACCTCCACCC CAGGTCTCAC CAAAAGTGGG TGGAATGGTG AAGAATTCAG
46141 ATCCCCAACG CCACTCTTTC GCGCCCCAC CGCCCAACGC ATTCGTTCTG AGGTGGAAAC
46201 CCCGTGCGGA TCCTGCTGTG GGTTTGCTCA GCCTTCTCGG CAAGCACTCA GGGAAGAACT
46261 TCCTGTTTGG AGATGACTGG GGAAAAAACT GCACAGCTGA CATTGGAAAT AAACCCGAGT
46321 TCCAGGTTCA AGGAGCCCCA GGCTTAGCTC AGCTCAAGTG AGGAACTACG AGATTTATTT
46381 AAAAGCATTC TAGTTGGGGG AAGGGAGTGG GCGGTTCCAA AAGTCACTCC GCAGAGCCGG
46441 GACAGCCGGG GGAGGGGGCA GGTCCTGGGG CGAGGGACCC CTATCTGCAG TTCAGTGGTA
46501 GGCACTCCCT CACGGGGTCT GGACGCAGAA AGTAGGGAGA GGGGCTTGCG GATTGGGTTG
46561 AGCAGGTCCT CCAAAGTTAG CAAACTCCCA AGCGCAAAGA AAAAGCTAGT TTCGATTTTT
46621 CCACCCCCGC CGCGCCCCTA GTTCGCCCGC AGCCCTCGGA CTCACGCAGC AAGCGCCCCT
46681 GCAGGACCGC GGTCTGCAAA AGCATCAGGA GGAGAAGCGC CGGCCTGGCT CGCGGGCCCA
46741 TTTCCCCAGC TCTGGCCGCA CGTCCCGTT AAATCTCCGC TTCTTTTGGG GGGCGGGGAA
46801 ACGGGGATGG CTCCAGAAGT CACCCTACAG CTATTGCCTA GGCTCAGGAG ATGCCCAGTA
46861 AAACTTCCTG GTGAAAAGCA ACAGGTCTTT CAGAACTTTA GTTCTCTCTC TCCTACAGCA
46921 GAAGGTACCT GCTTGTGAAA CACTAGGTGA TCCAGTGTCC CCCTTGGTTT TTAAATCCTG
46981 AAGGGGTGTT GTTGATTGGG GAAAGTAGCT TCGCAATGTT CTGATCTGAA CTTTAGATAT
47041 TTAAATATTT ATGATTTTCA AAATTCAATC ATACATTTAA AAATTTTATC TCAACCTTAG
47101 ACCAACTTAT GTCTTATTTG ACTTAGAAAT ATAAAGCTTT TTCATTTTGT TTTTTGATTC
47161 AAATTAATTA AGTCATAACA TTAACCAATT AGATCCTACT GAAACACGTT CCACAGCCTT
47221 CATAATTGAA TTATCTGACA AGTGTTTCAC AAACTTTACA GTATTGGGAT TATCTGGAGA
47281 ATGATTAAAC ATATTGAGGC CTGCTCCTAA CCCCAGACAC ACTGATTTAA TGGGTAATTG
47341 TTAGGTAGTT AGACATTAGC AGTTGGGAGG GGATGACAGA AGAGAGCGGA AAGGCTGTCA
47401 CTAAGACAGC CACTGGCCCA CCTAAATTCA GGCCCAAGAC TACCCTAATG CCACCCTAAG
47461 GGATGGAGTT TATGATAAAG TCTGTGGCCA AAATATCCTG GAGAAAGAGA AAGGAGGGTA
47521 CAGGTGGAAA TTCCCTAAGG TGGCACATGC CCAACAACAC AAAAGCCTGT CTTCAAGTTC
47581 ACCCAAGTT CATCATGCCA TCATTATAAT AGAATTTACA TACAGTTTTG CCCCCCCATC
47641 CCTGGGAGGC TTTTCTTAAC AAATTATAGG TAAGACCATG CACAGTTTAA TTTTAGATTG
47701 TATAGCTATA AACTTCAATC AAATAACATC ATCCTGTCAC TCAGATACAG CCCAAACCTC
47761 AACTCCTCCC CACAAACCCC ATAAAAGCAC CTTGAGCTCT GTAAAGAAGT GCTGAGTTCA
47821 CTTCGCAGAA ATAAGCCCGC TGTCCCTCAG AGTGTATTAT TGTGCTTCAA TAAACTTTGC
47881 TTTAAGCTTG CATTTTGGTG TTAGTTTGTA GTTCTTTGCT CACTATCACA AGAACTGAGA
47941 TTGCTGCTTC AGAGCTCCGG CTATAATAAT CTCCTCGGTT AAAGGATCCA TCCCAATGCA
48001 TAATTCCCAG TAACAGTATG GGATGCCACC TGGGCAATGG GATTTTAAAA GCTTTCCTTC
48061 TCCCTCAACG AAGTTTGGGA ATTATTGCCT TAGACATTTC AAACAATATT AATAAATTTA
48121 ATACACCTGA TTTGCTCCAA ACCTTTACAT ATCTAGCAAA TTCAACAGGC ATTATTTTTG
48181 TAAGCATGTA TGCAAATTTT GGCAATTCAA GAAAATCAAA CAGGATATCA GGGCCTCGAC
48241 TGTAGGCAAA CAGATACAAT AACATTGGAA ACATGTAGAA TATTGATGAT GGGCACATTG
48301 GGGCTGATAG TACTATTCCT TTTTTTCAAT TTTTGGTAAG ATATAATTAG CATACCATAT
48361 AATTCATCTA TGTAAAATGC AAAAATTGGC CCAGCTCAGT GGCTCACGCT TGTAATCCCA
48421 GCACTTTGGG CGGCCGAGGA AGGCAGATCA CCTGAGATCA GGGGTTCGAG ACCAGCCTGG
```

Figure 2 (Page 15 of 74)

```
48481 CCAACATGGT GAAACCCCGT CTTTACTAAA AATACAAAAA TTAGCCGGGC GTGATAGCAG
48541 GCAACTGTAA TCCCAGCTAC ATTAGAGGCT GAGGCAGGAG AATCGCTTGA ACCCGGGAGG
48601 CGGAGGTTGC AGTGAGCTAA GATCGTGCCA TCGCACTCCA GCATGGGAGA CAAGAGCAAG
48661 ACTTCATCTC AAAAAAAAAA AATTAGCTGG GTGTGGTGGC ATGCACCTGT AATTCCAGCT
48721 ACTCGGAAG CTGAGACAGG AGAATCGCTT GAACCTGGGA GGCGGAGGTT GTGGTGAGCC
48781 GAGATCATGC CATTGCACTC CAGCCTGGGC AACAAGAGCG AAACTCCGTC TCAAAAATAA
48841 AATAAATAAA ATAAAATGCA AAAATTAATG GATTTTAGTA TATTTACAGA GATGTGCAAC
48901 CATTACCAAA ATTTTACATT TCTATCTCCC CAAAAAGAAA CCATGTTCCC CTAATTCAGT
48961 ACCCTTAATT CATCGCCTCC CAGATTCCTC CATTCTCCTC CTCCTCCCCT CCCAGCCCTA
49021 GACAATCTTT AATCTACTTT CTTTCTATTT GGAACATTTA GTATACATAG AGGCATATAA
49081 TATATTGCTT TGCCGTGACT GGCTTCTTTC ATTTAGCATA ATGTTTTTAT GTATGTTTTT
49141 CATGGACCAA TAATATCTAT TATAAGGACA TACCACAACA TATTTTATTT ATTCATTCAT
49201 CAGCCGATGG ACATTGGTTT GTTTCTACTT TATGGCTATT GGGAATAGTG CTGTTATAAA
49261 CATTTATGTA CAAGTTTTTT TGTAGACTTA TGTTTTGATT TCTTTTGGTT ATATATCTAG
49321 AAGTGGGTTT GCTGGGTCAT ATGGTAACAC TGTTTAACCT TTTGAGGAAT TGCCACATTC
49381 TTTTCCAAAG TAAGCATTTT ATCCTCCTAT CAGCAGTGTA TGAGAGTTCT GATTTCTCTC
49441 CATCTTTGCC TGGGTTTTTG AATCAGGGCC CCAGATAGAA CAAAAATGTG GTTATTCAGT
49501 TGTTCCACCA TCACTTGTTG AGAAGACTCT TTTTTCATTG AAGTGTTTTG GCACCCTTAT
49561 CAAAAATCAA TCTACCATAA ATGTGAGAGT TTATTTCTGG AGTCTCAATT TTATCCCATT
49621 ATGCTATAAT CTATAATCCT ATCTTTTTTT TTTTTTGACA GAGCCTCACT CTATTGCCCA
49681 GGTTGGAGTG CAGTGGCCCA ATCCCGGCCA CTGGCTCCTC CTCCCAGGTT CAAGCAATTC
49741 TCCTGCCTCA GCCTCCCAAG CAGCTGGGAT TACAGGTACC TGCCACCATG CCTGGTTAAT
49801 TTTTGTATTT TTAGTAGAGA CGGGGTTTCA CCATGTTGGT CAGGCTGGTC TGGAACTCCT
49861 GACCTCAGGT GATCTGCCCA CCTCAGCCTC CCAAAGTGCT GGGATTACAG GCATGAGCCA
49921 CCACACCCAG ACTATAATCC TATCTTTATG TCAGGACTAC ACTGTCTTGA TTACTATAGC
49981 TTTTTAGTAA ATTGAATTCA AGAAGTTTCT CAACTTCAAA TTTGATCTTT TTTTGGAAGA
50041 CTATATTAGC TATTCTCAGT CTGCTGAATT TCCCTAGGAA TTTTAGGATC TATTATCAAT
50101 GTCTATTCTA TTTTTGTATA TGTTTTAATA TTTTCATAAG AAACTTTTTT CATTTAAACT
50161 TTTTTTTTTA AGAAAAATAG TGAAAATCAG AATACTGGGG GTCAGGCGCA TTTAACAGGC
50221 AGAAGAAGAA TAAAAACTTG TCATATAAAC AAAAAAGAAA TGACCAATCA CATTGTGGAA
50281 GCCATGGAGT GGTTATAGGT GCCAAAGGCT GCAGAGAAAT GGTGTCAGAT ATACCTGAAA
50341 ATTGTCCATT GTATTTGGCC ATTAAGAGAC TTAGAAGACT TAAGCCATAG ATTGCTCAGT
50401 GAGACCCCGA GGGCAAATGG TCTGAAGGTG AATAGATCAT TTCACCTTTA AGAGAGCAGG
50461 TAGGAAGCTA TAAATCCAAG ATTAAAAAGT TGACTGAACT GTTAAAGAAG AAACTCTAAT
50521 CTTGAGCCAC CCTATCCTTG CTCCACCTTC TGCTGCAAGC AAACAGAAAT GCTGAAATTC
50581 AACACTCACA AAGGCTGGTA AGCTGGAAAT GACAAAAATT ACTCCTGGGA AGTCAGATT
50641 TAGAATTAGG CCATATTTGT TGGGGTTCAG ATTTTCATGT ACACTTGGGA AAGGGTTTAG
50701 CTTATAGGCA CATGCATGAA GGGAACTGGT ATAGGGCTGT GTTCATAAGG TCAAGAGTTG
50761 AAGGCCAGGC ATGGAGGCTC TTGCCTGTAA TCCCAGCACT TTGGGAGGCC GAGGCAGGAG
50821 GATGGCTTGA GCCCAGGAAT TCAAGACCAG CCTGGGAAAC ATAGGGAGAT GCTGTCTTCA
50881 CAAAACAATT AAAAAATAAA ATTAGTCAGG TGTGGTGGCA CACACTTGTG GTCCCAGCCA
50941 CTCAGGAGGT TGGGAAGATC ACTTAAGCCT GGGACATTGA GGCTGTAGTC AGCCATGATA
51001 GTGCTACTGC ACACCAGTCT AGGTGACAGA ATGAGACCCT GTCTCCAAAA AAAGAGCTGT
51061 ATCCACATCC CAGGAAAGTG GTTGAAGATC TACTTTTCTC TGTAAACCTA ATAAAGAATA
51121 GAGTGACAAA TGTGTGTTGT GGAAAGAAAT GGGGTGAGAG CTACGTAGAT GCAAAACAAT
51181 ACATCCCCAC ATACCACTTG TTAATCATCC TTTTCCACCC ACTTATGGGA TGAATTGCAT
51241 CTCCCCAAAA GATACTCTGT CCTAACCCTC AGTACCTGTG AACCTGACCT TATCTGGAAT
51301 ACGGTGAGTT CACTGGTTAA GAAGAGATTA TAGTGGAATA GGGTGAGTCC TCCAACCAAT
51361 GACTGGGGTC CTCACAGACA CAGAGGGATG ATGGCCAGGT AGAGATGGAG GCAGAGATTG
51421 GAGTTATGCT GCCACAAACC AAACACAGGA AGCTGCTAGA AGTGGAAACA GGCAAGAAAG
51481 AATCCTTCCC CAGAGGCTAC AGAGGGATCT TGGCCCTGAT AATACCTTGA TCTCAACTGG
51541 CCTACGTAAC TGTGAGAGAA TAAATTTCTT TTGTTCTAAG CCACCCAGTT GATAGTACTT
51601 TGTTACGGCA GCCCTAAGGA ACTTGATATA CATTTCTTTT ACTGTCATAG AAGTTTTGAA
51661 TCTTTTAAGT AGGTCTGTAC CCTTCCTCCC AGTGTCAACG CATGGAATTC CTCTCCTTGT
```

Figure 2 (Page 16 of 74)

```
51721 GCCTTGAAAA GTGAAAGGTG TTTGAACTGG TAATGAAAGA AATCTCAGCA TGAGGCCAGA
51781 TGCTGTACCT CACACCTGTA ATCTCAGCAC TTCGGGAGGA TGAGGCGGGC AGATCACTTG
51841 AGGTCAGGAG TTCTAGACTA CTCTGGCCAA CATGGTGAAA CCCCATCTCT ACTAAAAACA
51901 AAAAATGTTA TCCTAGCCGG GCATGGTGCC TGTAGTCCCA GCTACTCAGG AGGCTGAGGC
51961 AGGAGAATTG CTTGAACCCG GGAGGTGGAG GTTGCAGTGA ACTGAGATCA CGCCACTGCA
52021 CTCTAGCCTT GGTGAGAGAG CAAGACTTGG TCTTAAAAAA GAGAAAAGAA AAATGAAATT
52081 TCAGCATTAT AGAATAAAAA TGTTTCCCCT TCCCCCCAAA CTTTAAAAAA GCAGAAGTCT
52141 GCATCATAAA ATGGTCTTTG CCAATGTTAT TTTTATTATA ACAAAGGAAT CTTGCAAGGC
52201 TACCAGATCT CAGCAATTGT CACTATGTTC TGTAAAAATC ACTTCCTAAA ATGTCTGAAT
52261 TGACTGCTTG TCTCATTTAT TTGTTTCTCG TGTCATACTG CAATGGATAT CTGTCTTGTT
52321 AGTATAAATA TTTGTGCATT TTGTTGTTGT TAAAACAGCT TTTTTGGCCT GTCTTCTTCC
52381 ACCTATGAGG TAATATAAAA CTCATGTTTA ACACTTATTT TTGTAGGAGG ACAAGCTACA
52441 GACAAAACCC CTCAGACACT GAGTTAAAGA AGGAAGGGCT TTATTCAGCT GGGAGCTTTG
52501 GCAAGACTCA CATCTCCAAA AACCGAGCTC CCTGAGTGAG CAATTCCTGT CCCTTTTAAG
52561 GGCTTGCAAC TCTAAGGGGG TCTGTGTGAG AGGGTCATGA TCGACTGAGC AAGTGGGGGT
52621 ATGTGACTGG CAGCTGCATG CACCAGTAAT CAGAACAGAA CAGGGATTTT CACAGTGTTT
52681 TTCCATACAA TGTCTGGAAT CTATAGATAA CATAACCGGT TAGGTCGGGG GTCAATCTTT
52741 AACCAGACCC AGGGTGCAAC ACCAGGCTGT CTGCCTGTGG ATTTCATTTC TGCCTTTTAG
52801 CTTTTACTTT TTCTTTCTTT GGAGGCAAAA ATTGGGCATA AGACAATATG AGGGGTGGTC
52861 GCCTCACTTA TTCACCCCCT TTGAGAATCT CACTCATTAG TGGGAGTTCT CACTTTTATT
52921 CTCACTACCT ATGTCTTCTT GAAAGACAGA TTGATAATGA TTCATATAGT ACACTTGTGC
52981 TGAAGCATTT TGGTGAGCTA AGGTAGTGAT GAAGCTTTTT ATCATTTGGA GAAGTACAGG
53041 TAGCAAACAA GGAAGCAGTA AGCAGGTTTC TATTAATATT ATAACTCCTA TTATAAGAGT
53101 TTTAAATCTT CTTAGCACTC GGAACCATTT TTCAAACATG GCCCAGAAA CAAATCCATA
53161 CCACACCTAC ATGGGCACAT GTGCCACTTT TGTCATATTT CTAACTATGT CTTCAACTAC
53221 TTGCCCTTAA TCATCTATGT GTAGACAGCA ATTAGTAAGG TTAAATTTCC TACAGACCCC
53281 TCCTTCAGTT GCTAGCAAGT AGTCGAGAGC CAATCCATTT TGATAGATAG CATTTTGCAT
53341 CTGAGTTTCT TGCCAGGCCA CAGTAGTCAG GGCTCTGCTG GTCTTATTAG TAATTATTTC
53401 TAAGACAGCT TGTAACCGTA TGATTCAGTT GAGCATGTAA ATGGGGGTCC CATATCCCCA
53461 CAAGCCGTCT TGTGCCCAAG TAGCAGGCCC ATAATATTGT ATGATTCTCT CAGGGGGCCA
53521 TTCATTATTT TTCCAATTTT CTATAGCTAT GCTTTTTTTT TTTTTTTTTT TTTTTTTTTT
53581 TTGCGGGAAG CATATACAGG GAAGCCCAGG AGTTTGCCTG TCTTTATGGG CAGTAGGAAG
53641 AAAGATGGTT TAATAGTGTC AATAACACAA CTACCTGCCC ACTGGTCAGG TAATTTGGCA
53701 TAAGCTGTAT GCCCACATAT CCAGTATAAT CCAGTGGGGG CTGTCCAGTC CCGGTGGGAC
53761 TCTGGGTGGG TCCACACAGT TTGCAACTTT GGGAATTTAC TAAATAGATT TTTCTTAGTG
53821 TGGTTTGAAC TCCACTAGGT GGCTGTTTTT ATAGTACTAT TATACAGTTT TTGCCCAAGG
53881 CAGCTGAGTC TTCCCACAGG AAGGGTGAAG TCCTTCCCCA CTTTTGCTAT ACAGTATTGT
53941 CTAATGATTG AGGCTTTTAG GACCCAGAAG TTATCAGGGT GAGTCTTTTG AGCTGGGAAT
54001 TTATCAGGAA CTGGGTCTGT AGGTACTAAT TCTCGTGCTT CCCATGGCCA TTGATCTCCC
54061 ATTACAGTTC CTCCACATAC ATACATAACA TGAAGTGACA TTGAGAGACT GGGCTACATG
54121 CTCAGCTAAT TGCAAAAACA AATTTCTTGT TTTTCCTGGA ATTTCTAGTA CTGGCACATT
54181 CAGTTCATCA TAAGAAGGTT TGAAATACTG GCTCAGGGA GCATTTATAA ACTTCTCCTC
54241 AAACCACCAT ATTTACTCAA GGATCCAGTC CAGCCCCAAC TATTTCTAAG GTTACACGAT
54301 CCCCTTTTTT CCAGTGAGAA TCAAGGGGT TGGTTATTAC TAGTTCTAAG GGGTTACACT
54361 GACCACTGGT ACAGGAAGGG CCACTTTTCC CTTTCTGAAG GTGGACAGGA TTCTTTTTAT
54421 TTTTTAACCA AGTTGCCTAA ATGACACAAG ACCAGTATCT ACATTTATTT CCACGCAGTC
54481 TTAATTCATG ACAAGCGTAC TTATTTTCTG CCATATAGCC TCTTTCCTAA TGAACAGAAC
54541 CACATCCTAT TTCTAACTTA TTACTATTAA TGACAGCACA GGCATCAAAT TTCAAGGTGA
54601 CTTGTTTGGG CATTCCTTTT TCTTCTGTTT TGGCTAACAC TTTACTCGTA TCGTTTATGA
54661 ACCCCACCA GTCCTCAGTC CTCAATCTTA TTTCAAAAAC TGTGGTCGTG GGAGGCTCAG
54721 ATGGGTCATA ACACACATCA GGTTGGTCAT TTCTTGGGCT ACCTGCCTTG TATAGAATAG
54781 CATTATACAA ACAAGTTATT TTTAGAGTCT TTGTACACTT ATAATAACCA TAAAATAATA
54841 AGACTGTAGC AACTTTTTGT CCTACCTCAG TGACTTGATG TATACACTGG GAACAGCCCT
54901 CAGTCTGAGG AAGGTTAGTT GAAGTCTTTA CTGTGCAAGT CCAAATTTTA AGGAAAATGA
```

Figure 2 (Page 17 of 74)

```
54961 GTCCCTTGAT GAGTTTTCTC ATGTTTCGGC CATGCATGGA CCAGTCAGCT TCCGGGTGTG
55021 ACTGGAGCAG GGCTTGTTGT CTTCTTCAGT CACTTTGCAG GCGTTGGCGA AGCTGCCACG
55081 TACAGCTCAC AGTCTACTGA TGTTCAAGGA TGGTCTTGGA AGTTGGGCCC ACTAGAATTA
55141 ACTGAGTCCA ATACCTCTAC TCAGTCACTT TCAACTGGGC TTTCTGATAC CAGGAGCAAG
55201 GTGGCAGGTT TTAGGGTGTT GCAAATTTCA ATGGTTATGC AGGGATTTTC ACATAGCAAA
55261 CTTTGGTACT TGGTTAATCT AGCATTTGTT AGCCAATGAT GTATTTATTA AAGTCACCAC
55321 AGCATGGAGG GCCTTTAAGT TTAGGTTTTG TCCAAGAGTT AGCTTATCTG CCTCTTGTGC
55381 TAGCAGGGCT GTTGCTGCCA AGGCTCTTAA GCATGGAGGC CAACCCTTAG AAACTCCATC
55441 TAGTTGTTTG GAGGCCCAGC CTCGGCCAGG GCCCCACAGT CTGGGTCAAA ACTCCAACCG
55501 CCATTTTTTC TCTTTCTGAC ACATAGAGTG TAAAGGGTTT TGTCAGGTCA GGTAGCCCCA
55561 GGGCTGGGGC CGACATGAGT TTTTCTTTTA ACTCATGAAA AACTCATTGC TGTTGGTTGT
55621 AATAGATGTA GTTTATCCAA TCTACATTTT TATTAACTGT CACCCACCAA AATATTGACT
55681 CAAATCCTGC AGCTATTTGA TTTGGGATT TAAATTGATC TGCTATTCCC TGTGGGACTC
55741 CAATTGCATC TAAATAGATG TGAGAGTTGA AAGACACATA AGGGTCTTCT CTTGCTTTAC
55801 GATGTCTTAT TTTTCCTCCC TCTGGTTGAT GAAATGCTAG GGTGAAAGGG ATAGCCAACT
55861 GGACTAAAGT ACAAGTGCCG CTCCAGTTAT TTGGCAGAGT GCCCAGTAAA GGTCCACCAC
55921 AATACCACCA CACATCCGCT TGGGGATGAA CAAAGGCTGA CTGATTGAGA AGCTCCTGAA
55981 AATTCTTAAG CTCACTGCAT CCCTTCAGGT CTCCAAGGAA TGCTAAGTTT CCTCCCTGTC
56041 ATGAGAGACA AGAAGTGAAC TTAGTTTTGG GAGATGGAAG CTGGATGGCC CTCAGGGGTT
56101 GACCTGCAGG GTGCTGGACT TTGGGATATA GCAGAGAGAG CTTGGCACGA CTTATTACTC
56161 CAGGCTGTAG CATCCTGGAA AACAGTTACC ATGCAGCCCA TGCCTGGTCA ACAGGAGGAC
56221 CACCTTAGTG GAAAGGGGAT AATCTGGCCC TCTGGCCTGC CATGTGCACA AGCATAACAA
56281 TTGGTTTTGT TTAATGTGTG GACAGAATAT TTGATCCATT CCAACTGGGC ATTTGCATCT
56341 TGGTATCCTG CTTAATTATC AAAGTTTGTT TTAAGTCTTT AACTTCTATG ACCCTCTAGT
56401 AAAATGAATG TATGATTTTA GGAAATTACA AAAACCGGTT GGGGCAGTCC ATCCTCGCTC
56461 TTTAGTGGTC CACACAACAT TCGACCAACT ATGGCATAAA AGCTCTACAT CAGGGGGCAA
56521 GACTCCTCGT TGACACTGGG GTCTTTATTG AAATCTCTCT GGATTAAATG GTCTCAGTTT
56581 ACTAAGGCTC AGTCTGAGGA GAGTCAGGAG GGACAGAGGT ACTTTTCTGA AGTACAGAGA
56641 TGTCTTCGAC TTGGCAAGTC CCCACAGGGT ATAACAAGGC AAGCATTAAA TTCAATAGTT
56701 TGAGGCAAAA TTGACTTGGT TATGTTAATA ACTAGATGGT CAGAAATAGA GTGAGGGAAG
56761 AAGAAAGAGT AATAGAATAG ATGAAGGAGT TAAATTTTTC TTAGCTTTAG TTTGGTAGGG
56821 TTTTCCCCTG GGACTATGGC CCATGACTCT GGAGGGGGTG GCACTTTCTT GACTCGGGTG
56881 TGATGAGTCC ATCCCTTTTT CACCGTATGA CAACAGTCT CGGTGGTTAG CAGCACAAGG
56941 TAGGGTCCTT CCTAGGCTGG CTCAAGTTTT CCTTCTTTCC ACCCTTTGAT GAGAACATGA
57001 TCTTCAGGCT GGTGCTGGTT TACAGAAAAT TCTAGGGGTG GTACATGTGC TAAAAGACTT
57061 TTAGTTTTGA GGGAAAGGAA AGTGGAAGAT AAACCAAGTA TATAACTTTT AAGAAGTTGA
57121 CCTTTTGTTT TAAATGTGGG GACATCAGCA GTGGACTTTA TAGTCCTTGG TGCCTTCTTA
57181 CTGAGAAATT TCCTTTAGCA CCTATTTTTA TTAGTTTTTA GACCAAAGAA AGTCAAATGC
57241 CATTTTATAT TTGACAACGC TTCTTGTATG TTTATACCAG ATAAGCTAGA TTTCACCTTT
57301 ATATTGGTGT GTTATTAATG TTAAACTTAG TTTTAATAAA ACTCTGTAGA CATATTTATT
57361 TGATTTTAA TGTCTGACCA TAAGGTAAGA TTTTTATAGA CTTTTCTTTA ACCTTTTATA
57421 ATTTTTGTTA AAGAACAGGT TAGTGCTTTA AGAAAAACCC GTTGTGTTTT TATTTTAATG
57481 TTCAGTTCAC AGAAAAACTG TATGATACCC CTTAACTTTA GCCAATATGT TTAGACACAG
57541 AATTTCTTT ACAATTAAGG TTTCAAAACT TGCTTAAACC TTCAAAACAA TTTTTGTAAC
57601 CTTTTAATGT AGGTAAAAAT CCACATTCTT ATGCATCCTC ATAATCCTTT TACCAAAGGT
57661 ATATTTACT TTCCTTACAT ACCTTGCACA TAAACTGTTT ATTCAATAGT TTTACATTTA
57721 GAAGGAGGCC TAATTACTTT TAAATTATAC AACATTTCTT GCATAAATTT ATTTTTCTAA
57781 CACACATTTT TTTCATGACT TTCACAGACA ATTCTTCGAC ATGCCTCAAC TTTCTGACTT
57841 ATTGCAAACA TCCCTTTCTT TAAACAACTA GTTAATTTAT CTCAGGACAA GGATTTTCCA
57901 TACAACATTC TTTTTTATAT AAATTCTGCC TCCTCTTTAT TTCCTTTTTT TTTTTCCGAG
57961 GATGATAACC ATTCTTTTCC AAAGCGAACT TCTTTTATGT CTGTGGACTA GACTGTCTAA
58021 GGCCACAAGA TTAGAAGTTA CTATAATACA TGTTACACTG TTAACTTTTA GCAAACTTTA
58081 CTTTTGTTGA AAACCTTGTA AGTTTGGGAT TTCAATTATC CTTTGCTATT AATAAGACCT
58141 TATTTAGTCC AAATTAACTT AGAATTGGTA TAGATGGCTT TTTTTTTTTT TTTAATTACC
```

```
58201 TGGGAGGAAC CATCTATCCT CCTGTCCTGA AGGGAGTTCC TCCTAGGTCT GGTCAGAGCT
58261 TTGTATGGTA ATTAAGATTT AGATCCCCTG TTAGGAAACC TGCCGGGTTA AGAGAATTTT
58321 CAGTGGTTAA TGTTAAATCA TCTTCTTTTT TCTTTTTTCC TTAGGATACT TCTGAACCGG
58381 TGAGGTGTGC TCACAATGAG GTTCCTGTA AAAGTTATTT TTTTACTTTC TTCTGTTAGC
58441 AAAGCAGTTG CCGCTACAGA TTGAATGCAT TTGGGCCATC CGCGGGTTAC TGGGTTAAGG
58501 ATTTTTGATA GGAAGGCCTT AATGCTTTTG GAATATGCCC TGACAACAAA GTGCCAGTTC
58561 CTTCCCGGTG TTCAGCCACT GCGTTGATCC TCCACGAGGG CCTGCCACGT GCTGCTCTGG
58621 TGAGGCGTTC CACCGGGGCA ATTGCCTACC TGGGAGCGCT CTCCAGATCT GTGTCGCTCA
58681 AACTGGCTGG AGTTCCCCGT AGGGATGCTC CACAGGGCAG GCCTAAGTCG CCTAAGGGGC
58741 TGCCTTGACC GTCCGTTAAT CACCTCTGTC TCCAAAAACC AGCTCCCTGA GTGAGCAATT
58801 CCTGTCCCTT TTAAGGGCTT ACAACTCTAA GGGGTCTGC ATGAGAGGGT CGTGATTGAT
58861 TGAGCAAGCA GGGGGTACGT GACTGGGGCT GCATGCATCA GTAATCAGAA CAGAACAGAA
58921 CAGCACAGGG ATTTTCACAA TGCTTTTCCA TACAATGTCT GGAATCTATA GATAACATAA
58981 CCTGTTAGGT CAAAGGTCGA TCTTTAACCA GACCCAGGGT GCGGTGCCGG GCTGTTTGCC
59041 TGTGGATTTC ATTTCTCCCT TTTAATTTTT ACTTTTTCTT TCTTTGGAGG CAGAAATTGG
59101 GCATAAGACA ATATGAGGGG TGGTCTCCTC CCTTAATTTA AACAAAATTT TCAAAGTCCT
59161 ACCCCAAGTA AATTGGCAAA TATTAATAAA GTTATGGCAT AGAAAATAAA AATGATTGTA
59221 AAAGGCGTAA AGATATTTCT GTGGGGAAAA CATTTGTTCA TTAGTTATCA GTTAAAATTC
59281 TGTGAAAAAT AACCACTAGA GACCCTAAAG TACCCAGGGG CTAATAATAA GAAGGGAGGA
59341 ACACCCTCTC AGTCCCCACC GTTACCTCCC CAGAAGGGAA GAGGAAGAGG GTGACTCCAG
59401 GAGAGCTGTG GTCTCCCCTC CCCATATGTC CACATATACC TGACCTCCCC TCCCAAAAT
59461 ATATACCCAA TATCTCTCCC ATATATACAT ATTTATCTGA CCTCTCCACA TATGTATACC
59521 TAAACTTTCT CTATATATCC ACATATACCT AACCCTCTCA CACACATATA GCTGACCTCC
59581 AGTGGAGGAA AATGGGGAAG AGAAGAAG TTATCAAAGG ATAAATCTAG GTCATACTCA
59641 GAAATGTGAA AAACAAAAAC CACACACAGA AAAAAAAAAC ACACACAAAA AAGAAATTGA
59701 TAAATTTGTT TGTGTCAAAA TTAAGAATTC CGGTTCAATG AAGGATCCCA TGGATAAAGT
59761 TAAGACACTG CTGTAAGGAT GGTAGAGAAT TAAATGTCTG AATCAGACGA AAGGATGAGT
59821 AATTAGAATG CACAAGCCA AGAAGAACAA AACAGAAACT CCACATAAAA AATGTATGAG
59881 GCCGGGCGCG GTGGCTCATG CCAGTAATCC CAGCGCTTTG GGAGGCCAGG GCGGGCCGAT
59941 CAGGAGTTTG AGACCAGGCT GGCCAACATT GTGAAACCCC ATCTCTACAA AAAATACAAA
60001 AAATTAGCCG GGCGTGGTGG TGGGTGCCTA TAATCCCAGC TACTTGGGAG GCTGAGGCAG
60061 GAGAATCACT TAAACTCAGG AGGCAGAGGT TGCAGTGAGC TGAGATCACA CCATTGCACT
60121 CCAGCCTGGG TGACAGTGTG AGACTCTGTC TCAAAAAAAA AAAAAAATTA TATATATATA
60181 TATATATATA TATATATATA TATATATATA TGAAATAAAT GAACAAGAAA TTTAGATACA
60241 GGAAAATCCA AAGCACTTGG TAATGAAAGA AAGGTAAAGT GATGTGTCCT TTTGCATTTA
60301 AAAGAGAGCA TTAACAAATT AGAGAGCTGA ATAATGCTCA GTATTGGTGT GGATATGGAG
60361 ACTCAGGAAT CCTCATACAC TGCTGATGGG AGTGCCCACT CCCTGGGAAT ATTTTCCAAA
60421 TATCATCTCA AACATATCCC ATAAGGTGA CAGGAAAGTG TGGGCTGACT GATATCCTTC
60481 ACTGAGAGAG GTGGAGGTAA AATGAAGTCA CTGCACAATA TAGAGTTGGA AGCAATGGAT
60541 TAGATGTCCA CATAGTTACG TGGAAGAATC CGTAAGATAC ACACACACAC ACACACACAC
60601 ACCTTTGTGT ATATTGTTCC TGGCAGGTAG GCATGGAGGT TTAGAGGCTT CTACATCAC
60661 ACCTACTGCA CACAGTAAAT GGCCAGGCTG AGCACTGACT TCCATGAAGG GAGATTGAAG
60721 GTAAGAGATT GAAGATTGTT CCCTGGTCTG GACCCTGCA ACTGAATATG CAGAAAAAG
60781 TACACCCCGC CACCCCGCTT CCCATCTTTC CTACCTGATT AGAATAGCTT TTTCAGAAAA
60841 CGTTGGCCAG GGGTTGTGGC TCACACCTGT AATCCCAGCA CTTTGGGAGG CTGAGGCGGG
60901 CAGATCATCT GAGGTCAGAA GTTCCAGACC AGCCTGGCCA ACATGGCGAA ACCCCATCTC
60961 TACTAAAAAT ATAAAAATT AGCAGGGCAT GGTGGCACAC ACCTGTCATC CCAGCTACTC
61021 GGGAGCCTGA GGCAGGAGAC TCACTTGAAG CACAGTGATG GAGGTTGAAG TTAGCTGAGA
61081 TCTTGCCACT GCACTCCAGC CTGGACAACA GAGTGACACT TTGTCTCAAC AACAACAACA
61141 AAACCCACCA AAACTTTAAA TCTACCTATG GCCAAATGCC TGCTAAAATG AGCACCCAAG
61201 AAGCAGTGTT CAGGAAAGTC AGATGAATAC CCTAAAATTA GATGCAATGT TGGCTGGTCA
61261 CAGTGGCTCA GGCCCTGTAA TCCCAATCCT TCTTGGGAGG CCGAGGCGAC AGATCGCTTA
61321 AGCTCAGGAG ATCGAGACCA GTCTGGACAA CATGGTGAGA CCGTGTCTCT ACAAAACGT
61381 ACAAAAATGA GCTGGGAGTG GTGGCGCACA CCTGTAGTCC CAGCTACTCA GGAAGCTGAG
```

Figure 2 (Page 19 of 74)

```
61441 GTGGGAGGAT CTCTTGAACC CAGAAGGCGG AGACTGCAGT GAGCAGAGAT CATGCCACTA
61501 CACCCCAGCC TGGATGATAG AGCCAGACCC CCATCTCCAG AAAAAAAAAT AAAGAGAGAG
61561 AGAGATGCAA TATTTAGGGT TCAACAAGAC TGAACTTCTG ACTCCTTTCC CTACCTCTCC
61621 AGCATGTTAG ATTCTGGGTC CTTCATCCTA ACCCCTGTT CATGCCATAG CCACCCTGTG
61681 GTACCAACTT TGGAAGCCTG GATCTTCATC CCCTCATGAT AATGAGTGTC CCATTCAGGT
61741 CTCCATGCTC AGCTTGGCAA GAGTATCTGT CTTCTCCTCA TGGGACGGTC ACATTCACCC
61801 AGCACTGACA GGTTCCATTC CCACTAGGGT GGCACCCTAT ATGGTCTGAG TCCAGGCCTT
61861 CCTGGTCCCT CAGTAATCTC AGCATGGTAG CACAATCGAA AAGGGCTAGG CACGGCAGCA
61921 CCATTTCCCA CCAAGAGGTC TGATGGCTCA TCACATAGAC TGAAGGAGAT TCTGAAGAGC
61981 AGAGGTGGAA TGAAGAATGA ATCCTGGGCT CTGCTCTTCC TAGGCCTGTC TTCCTCTCTC
62041 CCGAGATGTT AGCTAACTCA TGAGAGCCAG AAACCAACTG CAGGCTGGCC TCAGGCACTT
62101 AGGTAGTGCT TCAGCCTCAG CAGTCCACAT TCTAGGAACC CTCATAATAT GGGTTGAAGT
62161 ATGCATTCCC ACAAAAATAA AGTTGTTGAA GTCCTAACCA CCAGTACTGA AATGGGAAAA
62221 GTTCCCTTGT CCCGCTCGCA TGGCATGTGA TAGGAGTGTG GCTAATTTCT TCAGTGCCTG
62281 GCTGCTCAAA CCTCTAGGGG AACAGTAAGA CGGGCAGGTT GTGGGTCTCC AACCCCATGA
62341 CCCCACCACA GTGTCTAGGG TTGAATGTTT ACAGCTCCTG AAGCCACAGT GGGTGTGTGT
62401 TACAGGGTGC TCTTTTAGTT TTGCCATTTA TAGGCAGCTG GTGTTAACCA ACTCAATTAG
62461 ACCGTCTACC TTGTCCCAAG GACAGAAGAA GGCTTTCTGT ATCCCAGGTT CTTGCCTTGG
62521 TGTACCGGAA TAAATCAGAC CACACCTGGG CTTAGAGAAA GAGTGCAAGG TTTTATTAAG
62581 TGGAGGTAGC TCTCAGCAGT TGGGCAAAGC CAAAAGTGGA TGGAGTGGGA AAGTTTTCCC
62641 TTGGAGTCAG CCACTCAGTG GCCCAGGCTC TCCTGCAACC ACCCCAGTCA AATTCCGCCT
62701 CATTTTGCCA GGCAAACGTT TGTTGTGTGC TCTTCTGCCA GTGTGCTCCC CTGGACGTCC
62761 AGCTATTCGT GTCTTGTGGC AGGCCAGGGG AGGTCTTGGG AAATGCAACA TTTGGGCAGG
62821 AAAACAAAAA TGCCTGTCCT CACCGTGGTC CCTGGGCACA GGCCTGGGG TGGAGCCCTA
62881 GCCGGGGACC ACGCCCTTCC CTTCCCCACT TCCATATCAT TTAAAGGGAC CATGCCCTTC
62941 CCTTCCCAGC ACTTTCCCCC TCCTGTATCA GGACCTGTGA ATGTGGCCTT ATTTGGAAAT
63001 AGGGTCTTTG CACTTCATCA GTTAAGATAA GAGTGGGCTC TAACCCAACA TAAAGGGTGT
63061 CCTTATAAAA AGGAGAAATG TCATACACAG AGACTGACAC CTATAGAGAG AAAATGTGGT
63121 GAGTAGACAC AGGGAGAATC ACCATTCAAG TCAAGCAATG AGTCTGGGGA TACCAGAAGC
63181 TGGGAGAGAA ACCTGGAACA GATTATCCCT CATTGCCTTC AGAAGGAATC AAACCTGATG
63241 ATACTTTGAT TTCAGACTTC CAGCTTCCAG GACTGTGTGA CGATAAATAT CTGTTGTTAA
63301 GCCAACAAGT TTGAGGTACT TTGTTACTGC AGCCCCAGAA AACTAATACA GTAGGTACTA
63361 TGGACTGAAT TGTGACTCCC CGTCGCAAAA TTCATATGTT GAAACCCTAA CCCCCAGTGT
63421 GATGGTACTT GGAGCTGGGG CGTTTGGGAA GTCATTATAT TTAGACAAAC TCATCAGGAT
63481 GTGTCTCTCA TGATGAAATT CATGCCCTTA TTAAAAGAGA CAACAGGCCA GGTGCAGTGG
63541 CTCATGCCTG TAATCCCAGC ACTTTGGGAG GCTGAGGTGG ATGGATCACC TGAGGTTGGG
63601 AGTTTGAGAC CAGCCTGGCC AACATGGTAA AACCCCATGT CTACTAAAAA TACAAAAATT
63661 GGCCAGGTGT GGTGGTGCAC GCTTGTACTC CCAGCTACTT GGGAGGCTGA GGCAGGAGAA
63721 TCCCTTGAAC CCAGGAGGTG GAAGTTGCAG TGAGATCACA CCACTGTACT CTAGCCTGGG
63781 TGATAGAGAC TCCATCTCAA AAAAAAAAAA AAAAAAGAC AATAGAGCCA GGTGCTGCAG
63841 CTGATGCCTG TAATTCCAAC ACTATGAGAG GCTGAAGCAG GAGGCTCGCT TTAGCCCAGG
63901 AGTTCAAGAC CAGCTTGGAC AAAATAGTGA GACCCCAAC TTCTAAAAAT TTAAAAAATG
63961 AACTGGGTGT GGTGGTACAC ATCTGAGGCT CCAGCTACTC TGGAGGCTGA GGTGGGAGGA
64021 TTGCTTGAGC CCAGGAGGAG GCTGCAGTGA GCCATTGCTG TCCAGCCTGG GCTACACGAG
64081 AACCTGTCTC GGGAAAAGGA GAAACAGTG AGACCTCTTT TTCTCTCCTC CTTCTCTCCA
64141 CTGCCTAAGC CCTACAAGCA CAAAAGGAC ACCACATGAG CACATAGTGA GAATGCTGCT
64201 GCCACCAACA AGTCAGGAAG AGAGCGTTCA CCTAGAAACT GAATTGGCCA GCACCTGGAT
64261 CTTGACTTC TGAGCTTCCA GAACTGTGAG AAAGTTATTT TTTTTTAGC GACTAAGTCT
64321 ATAGTATTTT ATTACAGCAG CTCAAGGTAA CTAACATAGT AGAAGGGATG AATTATGGAG
64381 ATCACAAGTC CACGCCTCCA GAAAAGACT TCCCTAAAAA TTAGTCTGAG CAAAATTCGA
64441 ATGATGAATT ATTTTAAGA ACTTTTAAGG GATCTGACAA GTTTGCAAGA GCTAGAGAAT
64501 GCTTTACAAC GTGATAATAG AATGCTCTGT GATGACAGAA ATCTTTCCAC ACTGTTCAAA
64561 ACTAGCTACT GGCCACTTGT GACTATTGTG CACTTGAAAT GTGACTGGTG TCTGAGGAGC
64621 AGAATGTTTA ATTTTACTTA ATTTTAATTC ATTACAATAG CTACATGTAG CTAGGGGCTA
```

Figure 2 (Page 20 of 74)

```
64681 CTGGATTGAA CAGCACAGCT CGAGTCTTTT AGAGGGAGAC AGGACTCACC AAGGTGGATG
64741 CTGGTGGCCA AGCAGCAATG GCAGGTAGTA CACACACAAG AGGCAGATGA TACAACACAT
64801 CCTTCCCAAA CCTGGAGATA AGCTCACCCC ACAATCCCGC CGCTGAAATA GAGTTGATGT
64861 TACCAATGTG CATTTTATG TCCTTTTCCA TACAGAAAGA TCATTCAACA AGTACTATGG
64921 TACTTAAAAA ACAACATTCA ATTCATTATT ATGACAAAAT TAAATTAATA GCTCTTCCTT
64981 AAACTTTTAA ATTCAATTTA CAATGCTTAC TATTGGCATT TATTAATCTA CCAATTTTTT
65041 CCCATAGAAC CCATAGAACA AATAATCTAC CAAATTTTTA ACATTCATTT TTGGCAAGGC
65101 TTTTGCAATT TGACGAACTT TAAGAAGAAA ACTTATAAAT TGCAATTTTT AAATCTGACA
65161 TACTGGACTT TTAAAGTATC CAATTGACTA ATGAACAAAA CTGCTCCAAA TTTTTCAATT
65221 CTTAAAAATC TTAAGACAAT ACTTAATATG GCAAATCTTA ACTTCTTAAA CTTTGTAAGA
65281 ATGCTAATCA ACTTAGATTG GTATAAAGTT GAGTTAAAAA TCACAGGATA CATCATCTCA
65341 GCTATAAGTT TTCATGAGTT GAGTTTTTAC AATCACTTGA AATGCTTAGA ATAGGAAATA
65401 CGTATAAATT ATTTAACATA AAATATTGTT ACAAAACCTC TGGAGTGTCA GTTTCTCTGG
65461 CCAGACTTTA TGCTGCAGCA CCTTTGCCTG AGTTCTTGTC CTGCATCCAG GAAGAATTAG
65521 GTACAGAGGC AAGAGTCAAG AAGATTAGTT TTCCAATAGT TCAGCTCACC TAGTTAACTC
65581 CTGTTCACAA TCTTCAAAGT TATCAGAAAC CTGCAATTGA GGGTTATAAT CCATTCTTTG
65641 CAGAGTTTCA AAACAAGACA ACATTTGTCT ATGAATGTTA AAATGTCCTA GGGTAGTCAC
65701 AGTCAAAAAC ACAATTGACA AAGAAATTTA GTCACCTCTG TGATTTACAA TAGCCTAACA
65761 CAATAACTCT AATTATAACT GATGACACAA ACTCAGATAT CAGAACTCTA GAAATCCCCT
65821 ATAATTTTGG AACACATATT CACAGTTTTC ACTGAAATAT GACCTGAAGA TCAAATATCA
65881 CCTTATTTCA ACAATCCTAT ATAACTAAAC GTGTCAAATG ATCCTGTTTA CCTCTCCTTT
65941 GGATACTCCA GGGGCCCTCT GTAGCATCCA AAAGTTAGGG GTTAGCAAAG ACAATTTTGA
66001 AGCTGTAAAG GCTCAAAACA CTTAATGAAC CTCTAGTCAT ATCTGTTCTC TACTCACTAA
66061 ATGCTAGTAG CACCTCTCAG TTGTGGCTAA GCTGGGAGGA TCTCTTGAGC CTAGAAGTTT
66121 GGGGACGCAG TGAGCTATGA TTATGCCACT GCACTCCAGC CTGGGCAACA ATGCAAAATC
66181 CTGTCTCAAA AACAAAAACA AAAACAAAT TGCCTATGCT GTGGTTATCT CACAATTAAT
66241 AAAAAGGAAA AAAAAGTAT GCAGTCTTTG TAGGTCCTTG GGGTTTGTTG GAACTCAGAA
66301 AACAATACCC CAAAATAAAG ACCGCAGAAG CCAAAGTTTT TCTCTGATCT TCTCCTGCCC
66361 TCCTGTCTCT GAGTCCCATT CTCCCCGGAG TCTAGCCATA GAAATGAGAA TTCCTCTTCC
66421 TCAAGTTAGG TCATAGAAAT CAAAACACCT TTTCCCCAGA GCCCAGCCAT AAAACCTAAA
66481 AATATTACTC TAACTTTCCC TCTGTTTTTC TGTGTAAAAA CTGGCCATAA AGAAATTATC
66541 TGAACTACCT TATTTGATCA TAGATCACCA GACCGCATTC CAGAGAGGAT CCAGAAGGAA
66601 GGAATGCTGC ACAGAGAGGC CAAGAAGAAT CTAGACAGAC AGGCCTTGCT GGGTTTCCCT
66661 ACTCTGTTTA TTAGCAATCC TATTTCTACA CGGCGGCCCA TACTTTGTTG AATCTAAAAA
66721 ATAAAATGG ACAATTTCCC CTGTACATGT TAATACACAT TAATAAATTG GATATAAATT
66781 GGATAATTTA TTAATATACA CATTAATAAA TTGGATGCAG CCGGGTGCAA TGGCTCACGC
66841 CTGTAATCCC AGCACTTTGG GAGCTGAGGC GGGCAGACCA CGAGGTCAAG ACCACCCTAG
66901 CCGAAATGGT GAAACCCCGT CTCTATTAAA AATACAAAAG TTAGCTGGGC GTGGTGGCAC
66961 ATGCCTGTAG TCCCAGCTAC TGGGGAGGCT GAGGCAGGAG AATTGCTTGA ACTCGGGAGG
67021 CGGAGGTTGC AGTGAGCCGA GATTGCGCCA CTGCACTCCA GCCTGGTGAC AGAGTGAGAC
67081 TCCGTCTAAA AATAATAATA ATAATAATAA TAATAATAAT AATAATAATA ATAAATTGGA
67141 TGCATTTTAT CCTATTAATC TTCCTCTTGT CGGTGGTTTT CAGCGACTCT TCAGAGGCCA
67201 AAGAGTAAGT TTTCCCTTAG CCCCTACAGG TTCTTATGTT TAATTTGTTA CTCTCATTTA
67261 AGACATAATT AAAGTGGCTT CTCCATGAAG ATTATTTCTG CATCCATTAT TTGGTAAGAT
67321 TGGCCGTTTT CTCCTTTGAT CTCTACTTCA CACTGACCCA CATAAAACAT CACTGCCTGT
67381 TTTTTTGTTG TTGTTGTTTG GAGACGGAGT CTTGCTCTGT TGCCCAGGCT GGAGTGCAGT
67441 GGTGTGATCT CCGCTCACTG CAAGCTCCGC CTCCCGGATT CACGCCATTC TCCTGCCTCA
67501 GCCTCCTGAG CAGCTGGGAC TACAGGCACC CACCACCAAG CCCGGCTAAT TTTTGTATTT
67561 TTAGTAGATA CGGGGTTTCA CTTGTTAAC CAGGATGGTC TCGATCTCCT GACCTCGTGA
67621 TCGGCCCGCC TCAGCCTCCC AAAGTGCTGG GATTACAGGA GTGAGCCACT GCGCCCGGCC
67681 CCGTTTTTTT TTTTTGGTT TTTGCATGTC TTCTCCCTTT TACTGTAAAC TATTTCCACT
67741 ACCAGCGTAG TTATCATTTC TACTGCTTAA TAATTGTTTT GGGGAAGTGA ATGCATCAAC
67801 CCACATGAAT TTCTTGTCTA TTTGACAATT TATTCTCTTT AGGAATAGTA TTAACTCCTA
67861 AGTCCTGGG AGCCAGTCTC TGTACTTGGC TGCTCCAGGG TCCTACTTCA GTTTCCCAGC
```

```
67921  TTCTCAGTAC  TGTCACTGTC  AATTGTGGGT  AATAATTATT  TTTGTCCACC  AAAAGACTCT
67981  GTATGTGAAT  GAGTTTTGAA  ATCTGCTGAG  TAATACAGTG  TCAACCCAGT  TAATGATTTG
68041  CCGGGCGGCT  TGATCAGGGG  CTGTCCAACT  ACCGGCATTT  TGATTTGGAG  CGTCATCTAG
68101  TGTCTGAAAG  CACAAACAAC  ATCCTACATT  GTAAATGCCT  TTGGCTACAG  AGATTGAAAC
68161  CAAAGCAAAC  CTATGTTTTG  AATTGTTATT  CTTCAGCAGT  TCTGCTAGCC  TTGAAAAATC
68221  TAAAAGTTAA  AAAAAAGCTT  TATATTTCAT  TTTCTGCCTA  AACTCTTTAA  AATTGCTAGT
68281  TGACAATTAG  ATATTTTCAA  TTTAATGAAA  TTTTTTTTTA  GTTCACAGAT  TAATACACAA
68341  TGGGGAGGG   TTCTTATTCT  GTTGGACTTT  TACATAACCT  CCACTTTAGT  GCAGTCTGCT
68401  TTATGGGGTC  TTGTTTGAGG  TGTGTGTGTG  TTTAAGGGAA  TGTGGTTTAC  AATCAAAATA
68461  TTGGGTTGCT  CTTAGGCACA  TTGTAAAGTC  ACACACCTGT  ATTCTTATTG  ATACATAATG
68521  ATTAATAACA  TTATTATTAC  AGCCTGATCA  CCATCATTAT  TGATATATCT  AAATAATGAA
68581  TTTTATAATT  TTGCTTCCTG  TCAGGCAAGA  GCCAATTTCA  GTGCTACCAT  GTTTGTATAG
68641  CAGTATTTAT  GTCTGTCATC  CTCAGTCATT  TTACTTCACT  TGTTCTTAGC  CAAACGGCCG
68701  AGAAGCGATG  GTCATTTTAC  TTCAAAAATG  AAAAGAATTA  ATATTTTTAC  GTTTCCCTTA
68761  AAGACCCTAT  GTTTAACCTC  CACTCCCGGG  TAAAATGGTC  TAGTCCCTCC  TTTTCATATC
68821  ATCTCTGATA  TCTTTTGCAC  AGCCACTATT  ACCTACCGTT  TTCTAGATCC  CTATTCTTCA
68881  AACACCACCA  TGAAGGTAGA  GCCTGTCTGA  ATTATTTTCT  TGTCCCGTGA  ACTCAGTACA
68941  TTGTTAGGCT  TCTTGAAGAT  GTTGATCAGT  TGTTTGTGGA  GTGAATGAAT  CAGCTAGCAT
69001  GATTTTTCTA  GACCACTGAG  ACAAGTGTCT  AAGACACTTG  TTCCTTCCCA  TGTTCTTGCC
69061  TGCCTGTGCA  ATCCATGCAG  TCTCATGGCT  TCCCAGTGCC  TCAGAATTAT  CCCCTGTCAA
69121  ACAGGCATTA  TAATTTCTGT  CCACTGAAAA  GGACAAAAAA  CTAAGTGTAT  AGCTAGAAGT
69181  TAAAAATTAC  CGGCCAGGTA  CTGTGGCTCA  CTCCTGTTAT  TCCAACATTT  TGGGAGGCTG
69241  AGGCGGGCAG  ATCACCTGAG  GTCAGGAATT  CGATACCAGG  CTGGCTAACA  TGGCGACCCC
69301  GTCTCTATCA  AAAATGTAAA  AGTTAGCCAG  GTGTGGTGGC  TCGCACCTGT  GGCCCAGCT
69361  ACTCAGGAGG  CTGAGGCAGG  AGGATCGTTT  GAGCCCTGGA  GGTTGAGGCT  GCAGAAAAAT
69421  AGGAATATAC  TCTCTTTCAA  GAGTTCGTGG  TTTTGACTGC  CACCTAGCGT  ACATCAGAAA
69481  AACCGCATGA  CATAGGAAAT  GCCTGTGACA  GAGGGGTAAG  GTGAGAGAGG  TTGATGAAGA
69541  ATGTATTGAA  GGAGTGAAAA  CGCTTCCATC  CCTCTACTTA  CTAAATATAT  TAGTTAAGTA
69601  GTTGGGGCAT  ATTTTAATTC  ATGCATTTTG  TAGATAGAAA  AACAAAAGTT  TTATTCTGTT
69661  TGATTTAGTT  GATACTTTAA  TATGTGTGTG  TTTAGGATGC  ATGATTTATA  ATCAGTCTGC
69721  AGCACTTCTT  GGAGAAGTCT  GAATTCTCAT  TCTCCATTTC  CTTATTGGCA  ACGTGAGAAT
69781  GATTACAATG  GTGGTTGTCT  CATAGAATGC  AGGGAGTCAG  AATGAAAATA  GTCCATATAA
69841  TGCCTGGTGC  AGAGGAAGGG  TTCAGTTAAC  TGTCTGTATT  AATATTACTG  ATAACAGTCA
69901  TGACAAACAA  AAGCTTAACA  ACAACACCAC  CAACAACAGT  TGCAGAATTG  AGCCACCAAT
69961  TTGCACACAA  GATTGTAGGT  AGGATGTTTT  AGAAAAGTTA  TTATTTAATA  TATGTATATA
70021  TTTTTGTACT  TAAAATATGT  CAGAGGTTGT  TCTAAGAACT  ATTTAAATGT  TAACTCCTTA
70081  ATCCTCATAA  TGACCCATGA  AACAGGTAGG  CTTATTATTG  TCTCTTTACA  TGTGAGAACA
70141  CTGAGACACG  AAAAGGTTTA  TTAACTCACC  CAAAGTCACA  CAGCTGGTAA  AACGGCAAAA
70201  TTGAATTTGA  ACTCAGACAT  TCCAGGTTCC  AAGACAGTCT  AATTATTCTT  TTGACTAATA
70261  TACTAAGCTG  CCTCTGTATT  TTTCCTTGAT  TACTTTGTAA  AGTATGAGG   AAAATATAAG
70321  TGCTTCAAGT  AACCATGAAA  AATATAAACA  ATCTATGTAT  CAACTGAAGC  ATAATTACAA
70381  ATCCTTTGAT  AAGCAAACAT  AATAAAAATT  TGATATCAAT  CAAAACTTTC  ATGTAATGTA
70441  AGCAGGTTGA  GATGAATTCT  ATAGTAAAAA  AGTGCAGAGT  GCTGGAATAC  CATGCTCCTA
70501  ATATATTGGC  TAGGCACACC  TGCCTGCTAT  CAAAGGTATG  CACACACCTT  GGATACAGAA
70561  AGTTGGGACT  GGGTAGTTAT  GTGAGTGTCA  TCAGAATTCT  TTCCCACTTG  GGAAAGAATT
70621  GTCCATCATA  AGCTTGGATG  ATGGACAAGG  AGTGAGCTCC  CAGAACAGTG  ATGTGGGAT
70681  ACATCCTCAC  ATCACAGTGA  GAATGAGTGT  TCTAGACTGT  TTACACACCT  ACCACTCCTA
70741  AATGCACACA  TATAATTGCT  TGCACACACA  CACATACACA  CTCATCTCTT  CTCTGGTGGT
70801  CCAGCTCTAT  CTCTTATCAT  TAGGCTTCTT  GGGGCTAGTA  CCTAGGGCCT  GTATCCTTTC
70861  AGAGGCAGCT  AAGGGAAGCA  CACATAATTA  GAAAGAATGA  ACCAGCTTGT  TGGATTTGGT
70921  CTCTTCGCAT  CCAGCCCTCC  AAGTTAAGGA  GAGTACCATC  TTTCTTAGGG  TCACCAAAGG
70981  AAAAAAAAAA  AAAAGAAAGA  AACAGAAGGA  TATCATACAG  CAAGGATCTA  ATGCAAATAT
71041  GCCTCAAATG  AGAGGCTACT  GTGTGCTGAT  CCCAATCCCA  GGAACTGTAT  GCACATTATC
71101  TAATTTAATC  CTCACTGTAT  TTCTGGGAGT  ATTATTCCCA  TTTTACAGAG  AAGGAACTTG
```

```
71161 GCAGGGTAAC CAAGCTCATG AATGGAGAAA CTGGGATTAA ATATAAAGCT TCCTTGCTCC
71221 AGAACTGCTG TCTTTCTGCT CTTCCACACT ACCAGCTCAG CTGTGCTCTC TACATGCAGG
71281 CAGTTTTACA AGTTTCAGAT TAGCCTGGGA CTTCCAGGGT TTTGAATGGG TTAGGGAATG
71341 GGGAACTTTT GGGTTTACTT TCCATTTTTT CTTCATACAT ATGTAATATA TAACATAAAT
71401 CTATGGTATA TATGATAAAT ATATGGCTAC ATATGAACTA TATAATCACA TATATGCATT
71461 ATAAATAAAT ATTAATTTTA TAATATTTTA AAGGTTATCA AATAAATATT AATATAAATA
71521 ATTAAATAAT TAATACTCAG CTTTGTTTTC CAAAGTGATA AATGCCTATA TTTAGCAAAA
71581 TATTTTTTGG AGGCCTGATA GTTTTAGGA GTGTAAAGAA GTCCTGATAT CTAAATGTTT
71641 AAGAACCACT ATTTTAGGCT GTTGTCTTCT GTCTTATTTT CCCAGCTAGA CTGGTAAATA
71701 CTTGAAGGCA AACGTTTAGC CAGCACATTA ACATTTTATG TTTTTATTCT TTTGTGCTCT
71761 CAGTGGCTGT GTCTTTTCTA TCGATTTCTC ACACTGTATG ATGGTTATAT TTGTCTGTAT
71821 CTGTCCCACC AGGTATAAGT TCTTGAGAGG ACACACTGCT AGGCTGATCT TAGTTTTTAT
71881 TATTTCTCCT GGTGTCCTGT GCTTAACAAG TGCTCATTAA GTGTGTAAAA ACACAGCACA
71941 GTAAAAAACT AGACATTAAA AAATAATGTC AACCAATCTA TTGAAATTTG CATTTCCATG
72001 TTTCTTCCAA TATAGTCATT GTGTCAGGTT ATGTACTTAT TCTGATGAAG ACTATTGCCT
72061 AATATACGTT TGCATCTTGT GCTTTATAAC TGCCTTCATA TAGACACAGA TTGAGAAGGT
72121 GTAAAAATGT GCATATCCTC ACAATTGACA AATTCTTATC CTTGAGGGT AGGTTTGACT
72181 TTCTGAAATG CTTTGACATC ATTTGAAAGA AGCTTGAAGA ATAAGATAGC TGTTAATGAC
72241 CCAGTTTCCT ATGTCACTTA TACAATTATA ATGGCAATTT CAAAATGTTA GGTAAATATA
72301 TTTTGCAATA TATTGTTCCT TTTGTAATAC TCTCTATGTA TTTATTTATA TTTTTAAATT
72361 TTATATTTAT GTATTTATTT TTCTGGACAG AGTCTTGCTC TGTTGCCCAG GTTAGAGTGA
72421 AGTGTTGTGA TCATAGCTCT CTGCAACTTC AAACTGCTGG GCAAAAGTGA TCCTCCTGCC
72481 TCAGCCTCAT GAGTAGAGTA GCGGGAACTA CAGGCGCATG CCACTGCACC CAGCTAATCA
72541 CTATTTATTA TGCTCCTACT GTGTGCTTTA GTATATTTTC TGTTGTTTTC TGCAACCCAT
72601 TTTGAGGGCG TGTTAGGGAA TACAGATGCA GTAACTTTGG TCTCAGCCCT TGAGGTGAGG
72661 AAATATTTAG CCTCAGGTTT AATCTAATTG TTGGCCATTT GCCTTCAAAG ATTGAAATAT
72721 GAGCAAAACT GTGGCTCTGG GTTATATGTT AAAAAAAAGT TTATGGGGCT GAAGCCAGGC
72781 AACAGACAAG AGCCCCTACA ATCTTATTTA GGCTGAAAAT ATCCTGGAGT CCCTGTATTG
72841 TTGGTCTCAA GCAGATAGCA ACACTAACAC TTACTCTTTG AGGCAGGCAC TGCCAGTGGG
72901 GTGGCTGTTA TTATTAGCTT CATTAATTGG TGAGTCAGGA AAAAACAGCT TTAAATCATT
72961 CAAAGTTCTG GCCTATACAG GATTTAGTAA TATTAGGTTA GCTACATCCA AAAGATGACA
73021 GAACCCTACT CTAAGGCTGG GCTTGGTGGT TCACACCTAT AATCTCAAAA CTTTGGGAGG
73081 CTGAGGCAGG AGGATCACTT GGTGCCAAGA GTTTGAGACC AGCCTGAGCA ACATAGTGAG
73141 ACCCCTGTCT CTATCAAAAA CAAAGAACTC TAATTGGCAT AGTAGAAGGA AAAAGTGAAA
73201 GAAAAACCAG CTGTCACCCT CATTCCTTAC ACCTGTCCTA ACAACTCCTC TCACTATCCT
73261 TTGAATATAT CTTGGCTGTT TGAGTCTCTC TCTAGCCCCA TTACTGCTGT TTGGACTTGA
73321 CATTTTGCTC TGCATTTTTA ACTTTTCTAC CAGGGTTTCC AGACCCTGAA GAGTGTGGCA
73381 TGAAACAAAA CTAGTCAACC TATAATATTT ATGATGTGTG TGTAAATAAA AGAATACACA
73441 ATATATTGCA TTACAATATT TTAACTGTGT CCTCAATTTG TTTGTGGCTT TCTTGAGGAC
73501 ATCAGTTTTG GGTGGGACGA CCACATCCTT AATCTGAACT TTCCCTTGGA GGTCATTCTT
73561 TTTTTTTTGA AATAGAGTCT CGCTCTGTCA CCCAGGCTGG AGTGCAGTGG CGCAATCTCA
73621 GCTCACTGCA ACGTCCGCCT CCTGGGTTCA AGTGATTCTC CTGCCTCAGC CTTCCAAGTA
73681 GCTGGGATTA CAGATGCACG CCACCATGCC GAGCTAATTT TTGTATTTTT AGAAGAGACG
73741 GAATTTCACC ATGTTGGTCA GGCTGGTCTT AAACTCCTGA CCTCATGATC TGCCCACCTC
73801 AGCCTCCTAA AGTGCTGGGA TTACAGGCGT GAGCCACCCC GCCCGGCCAG AGGTCATTCT
73861 AATAGACTTT TTTTTGTTG TTGCTCACAG GCTTGTTCAA TCTTATTTCA AAATTTGAGA
73921 AATACAGTTT CCATGGAACA CCAACCAGAT ATCAGGTTGC TATGGAGTTG ATAGTCAAAA
73981 GCTTTGTATC TTCCAGTTTT TCAGAATGGC TTCTAAAGGT TCTGATTCAG AGCTCTTAGG
74041 CGAAATTGAA CAACCAAGTG TCAAAGTACA ACATTCAGGA AGTTAAAAAC ATGACTGACA
74101 TATATGTACT ATATATAGTG AGCTTGTGTA TGTGTCAATG AATGATTTAA TTCATTAATG
74161 AAGGAGGAAG CAGAATCACA ATTAGGTCAA AGGAAGATAC GGGAGAATAA AATATGTATT
74221 TGGTCAGGGA AAGGATGTAT ACTGGAAGAG GAAGGGAAAA TCAGATATAA AGTTGTTTAA
74281 TGACTTATTA GGCAATACAA TAATAACTTT TAGGGTCATT TTTTCTATAT TAAGAATTCA
74341 TTTCCATCTC TATGACAAAA TCCTTATTAA TTTATTAAAC TTCTACAAGT GAATGTTTAC
```

Figure 2 (Page 23 of 74)

```
74401 TTTTAGATAG TCTGGACCCA ATAAAATGTA AACATTAAGT CAGAGTTACT TTCACGTAGG
74461 ACAGTGTTGT CCAATAAGGT ACCACTAGCT ACACGTGATC ATTGACCATT TGGACTATAG
74521 CTAGACTGAT TTAAAATGTT CTAAAAGTGT AAAATACACA CCAGGTTCTG AAGATTTATC
74581 ATTTAAAAAA GAATGTCAAC TGTCTTTTTT TTTAGCTTAT TTATTATATG TTGAAGTGAT
74641 AATAGTTTAG ATATATTAAG TTAAATAAAA TATCTTAAAA TTAATTTTAC TTGTTTCTTT
74701 TCATTCTTTC AATGTGACCA CTAGAAATCT GGAAAGTATT TATGTGATTC ACATTCTATT
74761 TTACTGTCTA GTATTGCCTT ACATCATCAG GTACCCATA AGTAGGCTTT TTAGATAATT
74821 CTCTAATATA GCTTGGAAGG ATATGGAGAA ATATTTTGC GTTGCTTTTA AGTTTTGCAT
74881 AACTTTTTCA ACACACTTTA TAAAGGATCT AGAAAGGGT TGGTTACATG TTTCTCTGTC
74941 TTCTGGCCTC CACCATGTTG CCAGGAGGTT GGGGACAAGA TTCTGGGTGG CTGGATGTCC
75001 TAATGGCTTG AGGTCTGGAC TTGAGATTTG CATATAAAGA GATGTGATTA GATTGAGTCG
75061 ACTAGAAAAA TCATATTAGA GAACTGAATC ACAGCGATTA AATTTACATG TCGATTTATA
75121 AACCAGGACA CCAATTTATA GTGAAAGAAG GTCCAGTTAC CTGGTAATCA AGACGTTTCA
75181 TAGCTATTTT CATGATGGAT ATACTTAGCT GAGTTTTAAA TGAGAAGGGG GTTCATTGCA
75241 CATAGAATAA GATCTAAGTG AAATGTTTAT TTATTTTTT TTTTTTTTGA CATGGAGTCT
75301 TGCTCTGTTG CCCAGGCTGG AGTGCAATGA GGCAATCTCG GCTTCTGGAG TGCAATGAGG
75361 CAATCTCGGC TTCTGGAGTG CAACGAGGCA ATCTCGGCTC ACTGCAACCT CCACCTCCCG
75421 GGTTCAAATG ATTCTCCTGC CTCAGTTTCC TGAGTAGCTG GGATTAGAGT TGCCTGCCAC
75481 CACGCCAGGC TAATTTTTGT ATTTTTTTA GTAGAGATGG GGTTTCACCA TGCTGGCCAG
75541 GCTGGTCTCG AACTCCTGAC CTCAGGCGAT CTGCCCGCCT CAGCCTCCCA AAGTGCTAGG
75601 ATTACAGGCG TGAGCCACCA AGCCTGGCCT AAGTGACATG TTCTTATATT GTTCCTTTCT
75661 TTCTTTTTTT TTCGACTGAG TCTCACCCTG TTGCACAGGC TGGAGTGCAG TGGCGTCATT
75721 TCGGCTCATT GCAACCTCTG CTTCCGGGT TCAAGCGATT CCCTTGCCTC AGCCTCCTGA
75781 GTGCCACCAC CCCCAGCTAA TTTTTGTACT TTTAGTAGAG ATGGTGTTTC ACCATGTCCG
75841 CTAGGCTGAT CTCAAACTCC TGGCCTCAGG TGATCCGCCC CGAGTCTCC CAAAGTGCTA
75901 GGATTACAGG CGTGGGCCAC GGGGCCCAGC CTTATATTAT TTCTTTTACT ACAATATATT
75961 AGTATGATGC AGGTGCTTCA ATTGTTTATA CACTTTCCAT AATTTTGTAT AATTCTTATA
76021 CCCTGTCACT CTGAGGAATA GCCGGTCTAA GTGTTTTCC ACCACTGCTA ATTCATCCAT
76081 CACTAATCTC ATTAGACTGT TAATTCCCAG AGGACATAAG CACACAAGCA GACAATGTTT
76141 ACAAATGTTG GACAAATGTT ATTTAATAAA ACAATGGGGT CACCCTTAGT CTAAAAGATG
76201 TTTCACTTTT CATTTGTCAT TGAACTCTTA TTTGTAGGTT CCCTTTTGAC TTTCCCACAA
76261 TCTAAGGCTG TTCTCTTTAA CACATATTTT CATGAAAACA TATATTTGAG CAGAAATTGT
76321 TGGGGAGTTG TAATATTACC TTTGTCCCTA AATATGAATC TATAATTATA TCAAATATAT
76381 GGGCAGACAA TTTACTTTGC CTTTAATCTC AAGAAAAAAA TAGCAATTAC TTGGGGTCGG
76441 AGAGTAAAAT AAGAAGTAGT GAACCTTAAA GTAGCAAACT TTAGAACAGA ATAGTTTCAG
76501 AGGGGATGAG AAGAGGTGAT TTTTCAGCTC ATCAACAACA GATCTTATAA TAAATTACAT
76561 GTTCTGGTAC TTTTCTTGTC TTTCTGTGTT AAATTTTGCT ATTTAAAAAA ATAAATTTCA
76621 AATACATTGT TCATCTTAAA AGTCAAGAGT GTGTTTTATT AAAGTCAGTT GCTTTATTTG
76681 CAACTCAAAA GATATATTTG AGTTCCCAAC TGGAGATTGT CCTATATGGT AACTTGCGTA
76741 AGGTATGGTT ACTGAAAGTA ACCTACAATT TTCATGGGCT GAAATTCATT TCTATATTGC
76801 AGCGTACAAA AATAAATAAA TAAAAAATGC TTGTTTTCTT TGAAAACATA TTATCTCAGT
76861 GCCTCTAACT GCCAAATCTA TTGGCTTTTT TGCAGGCTTA AGGGCTCTCC CTTGTTCCTT
76921 TATGATCTCT ATCTTGAGGG CCAGACCTCC TGCCTTACAC AACTCAGAGG GGGACCTCAG
76981 AGCTCTTTAA AAAGAGCCCA ATTTCTCGCC TGTAGAGAAG TGAAAAGGAT GCCCCACCCC
77041 CATCTATGAA AAGAGGGATT TGATAGTTTC AATGTCTTCA AATCAAAGAT TTAAGTCTGT
77101 AGCCCCCCAC CACCCCGGAC CCTAGCAAGG CTCATGAACC CCCTCCCATC CCGCCCTAAT
77161 TGCTTTGGAC TGGCCGTGGA ATCCTTGTCC CAGTCCACAG TTCCTGTGCG ACTGCACGAA
77221 GAATTCACAG AGGACCTGTG TTACTTCCCT TGTGAAGAAA CAGAATTATC ATGAAAATTT
77281 AGGTGGAAAC CATTTCGCTT TTTCTTCAA AAATAAGGGA AGCATGTGCC CAACCACCCC
77341 TGGGAAAAAG AACCTTCAGG GGCAAGGAG CGAACAGGTA ATTTATAAGA AAAACAGAAA
77401 GTGGTCTCTG ACTGCCCCAG ACTTCCTTCG GAGTTGGGGG AATTGGGGAC GCCTGGACGC
77461 GTTGTTTTTG CGTTTGTGGA AAAAATAAAT GAAGAGCATG AAGCCCGAGG CTTCTGAGAT
77521 CCTTTCCTGA CCAAACCCAA GTGATTTGGT GCGGGGAATT TTAATATTTT TCCCCTTTTG
77581 TGAGGTGGAA CAAACACAAC TTGGGAGCAG CGCAGCGGCT CAGAGCCTGC CAGCCAGGCG
```

```
77641 GGCGACCAGA GCACCAATCA GAGCGCGCCT GCGCTCTATA TATACAGCGG CCCTGCCCAG
77701 ACGCTGCTTC ATCGGCGCTT TGCCACTTGT ACCCGAGTTT TTGATTCTCA ACATGTCCGA
77761 GACTGCTCCT GCCGCTCCCG CTGCCGCGCC TCCTGCGGAG AAGGCCCCTG TAAAGAAGAA
77821 GGCGGCCAAA AAGGCTGGGG GTACGCCTCG TAAGGCGTCC GGTCCCCCGG TGTCAGAGCT
77881 CATCACCAAG GCTGTGGCCG CCTCTAAAGA GCGTAGCGGA GTTTCTCTGG CTGCTCTGAA
77941 AAAAGCGTTG GCTGCCGCCG GCTATGATGT GGAGAAAAAC AACAGCCGTA TCAAACTTGG
78001 TCTCAAGAGC CTGGTGAGCA AGGGCACTCT GGTGCAAACG AAAGGCACCG GTGCTTCTGG
78061 CTCCTTTAAA CTCAACAAGA AGGCAGCCTC CGGGGAAGCC AAGCCCAAGG TTAAAAAGGC
78121 GGGCGGAACC AAACCTAAGA AGCCAGTTGG GGCAGCCAAG AAGCCCAAGA AGGCGGCTGG
78181 CGGCGCAACT CCGAAGAAGA GCGCTAAGAA AACACCGAAG AAAGCGAAGA AGCCGGCCGC
78241 GGCCACTGTA ACCAAGAAAG TGGCTAAGAG CCCAAAGAAG GCCAAGGTTG CGAAGCCCAA
78301 GAAAGCTGCC AAAAGTGCTG CTAAGCTGT GAAGCCGAAG GCCGCTAAGC CAAGGTTGT
78361 CAAGCCTAAG AAGGCGGCGC CAAGAAGAA ATAGGCGAAC GCCTACTTCT AAAACCCAAA
78421 AGGCTCTTTT CAGAGCCACC ACTGATCTCA ATAAAAGAGC TGGATAATTT CTTTACTATC
78481 TGCCTTTTCT TGTTCTGCCC TGTTACTTAA GGTTAGTCGT ATGGGAGTTA CTGAGGTATC
78541 AGAGACGAAT TGGGTGACGG GGTTGGAGAG TGGCCGTGGT GAGGTTACAG CATTTAAACC
78601 TTTATTGCGG CTTCTAGGTC CCTGACCGGA GGCTTTTCTC GCTGGCGGAT GGTTTTGGGA
78661 TGGCAGTCCC GCCCCAGGCC TGTGAACGGC AGAAAAGACC GCAAAACAAG AGCCAGTTTC
78721 TTAGTCTAAA GGGATGTCCG GATTGGACTA AAAAATTTTC AAAAGTCCCG CCCTGCTCCC
78781 GGGTTGGTCC GTTCTTCTAG TACATGACTT TCATTCTGTA TTTAATTGGA TGGTGGAAGA
78841 CGTTGCTTAT TCTGTGTTTT TTGCTTTACT GTGACTTAAA AGTTTTGCCT CTTTTCTCTT
78901 TATATTAATG TCTGGGATTT CGGACGCTTT CCATGTTGTT GGTAGTCAAG TTGATGTCTC
78961 CTGGAGGTAG TGGCAACATC CAGCCCTGGG AGGAGAGTGC GTGCAGGTAC CTTTGTCCTA
79021 CATTCCTCTG CTGTTAATTT CTCATTCCTG TGGCAACGAA GGAATGCATT TAAAAACAG
79081 CCACAACAGC GGCAATAGCC CTTCCTCCAC CCAAGGCAAT CGTGGACCTA GGGAGTTTTT
79141 TGTGCCACAT AACATGTAGC CTTCCGCTAA ACTGACAGGT TTGAGCGTAT CGATTTGAG
79201 CGTATCGAAA GCACAACTTT TAGCCAGCCA TTTTGTCCTC GCATGACTAC GGTTGCTTAT
79261 CCTGTTTAGA CAGACAGCAA CATTTAAAAA TCGAAGTTCC TTTAAACGTA TTTTGTTTGG
79321 CAGTCCAAAT GTTTCTATGC AGAAAACAGT ATTTGTACTA TTAACTATGA AGAGTGTATG
79381 GATAAATGGG AGACATTTCT AATAAAGGCC TTCGTTAATG GTTCCTCTG TTTGACATCC
79441 ATGGTGCTTC TGAATACAGA AAGCCTAGCG TCTTATATTC GCTTCTTTTA AAATCTGGTG
79501 GGCACATTTT GGTGAGACCT AAATTATGGG GACTGGGGCT TCTGGAGATA AGCTGCTCAA
79561 TTATTCTACC ATCTCCACAA TGATTAATAT AGTGAGTTGA TTTGTTAGTG ATAGTGACCA
79621 CGGATTCATC CCAAGAAAGA GAAAGGGGAG GGAGGCAAGC AGAGAGACAG GAAGACAGAG
79681 GCAGGGAAGA AGGAGAAAAC ATTCTCCCAT GGTTTAAGTA ATTTTGTGTT GTTAATTTTA
79741 CATTACAACA CGGTTTAACA TGGTGAACCC TCTATTTTGG TGTAAGGTTT AACATATGGA
79801 CATATTTTTC CCAAGACCAT TTATGAACTT TCATTTCTGC TTCCCCCTTC TTCCTCCCGT
79861 GCCACCCTCC ACGCTCCTAT CAATTTTGGC TGTTTTGTCA TAGGCTAATA CGCTATAATT
79921 TCATGGACAG TTGGACTGTC TTAGGTTTCT CAGGTTTCTA TTTTGTTCCT TTAGTCATTC
79981 CCACAATTCT TAAGGTAGAA TTGTATTGTT TTAAACATTG TGTTGTGTGC TATCCTCAAT
80041 GCTGAGATGA TTATGTGACA AATGGCAAGT GTTCAACTAA TACCTAAATC TGTAGTATCT
80101 TATCAAGCCT AATGCTACTT CACAATGCCT ACTCCATTCA CCGCACTTTA TCTCATTACT
80161 GGCATTCTGT CATCTCACAT CATCACAAGT AAAACGGTAA GCTATTTTGA GAGAGATCAC
80221 AGTCATATAA TTATATTTAT ATTTATTTAT TTATTTATGA GACGGAGTTT CCCTCTGTCA
80281 CCCAGGCTGG AGTGCTGTGG CACGTTCTCG GCTCACTGCA ACCTCCGCCT CACGGGTTCA
80341 AGCGATTCTC CTGCCTCCGC CTCCCGAGTA GCTGAGATTA CAGGGGCCTG CCACCATGCC
80401 CGGCTAATTT TTGTATTTTT AGTAGAGACG GGGTTTCACT AAGTTGGCCA GGCTGGTCTC
80461 GAACTCCTGA CCTCAGGTTA TCCGCCCACC TCATCCTGCC AAAGTGCTTA GATTACAGGC
80521 GTGAACCACC GTTCACAGAC TCAAATCATT TTTATTACAG TATATTGTTA TAATTGTTGT
80581 TTTATTATCA GTTATTGCTA ATCTCTTACA GTGCCTGATT TATAAATTAA ATTCATCATT
80641 GCCATGTGTA TATAGAAAAA AACAGTGTAT ATACGGTTCA GTACTATCTG TGGTTTCAGG
80701 CATCCACTGG GGGTGCAGTT TATTAAACAT GCATTTACAT TAGTCTCCCC TTTGGGAGAC
80761 TAATTAACTG AGATGTTGTA ACGTGACTTT AATAGCAGAT AGAGCTAATT TTCTCTCATT
80821 ACTCTTCTTT TTCAGAATTT TCCTGGTTAT TCCATTTTTT ATTTTTCCAT ATGTATATTA
```

Figure 2 (Page 25 of 74)

```
80881 AGATCTCTTC CACCTCCTCC TGTTTCTCCA TCTCAACATC AAACAATTAA AAAAAAAAAA
80941 AAAGGCTGGG CGCGGTGGCT CACGCCTATA ATCCCAGCTC TTTGGGAGGC CTAGGCGGGT
81001 GGATCACGAG GTCAGGAGTT CAAGACCAGC CTCGCCAAGA TGGTGAAATC CCGTCTCTAC
81061 TAAAAGTATA AAAATTAGCC AACCATGGTG GCAGGCGCCT GTAATCCCGG CTACTCGGGA
81121 GGCTGAGGCA GAGAATTGCT TGAACCCGGG AGGCGGAGGT TGCAGTGAGG CGAGACCTTG
81181 CACTCCAGCC TGGGTGACAC AGCGAGACTC CGTCATAAAA AAAAAGCCG GAAGCAGTGG
81241 CTCACGCCTG TAATTCCAGC ACTTTGGGAG GCTGAGTCAG GCAGATTACC TGAGGTCAGG
81301 AGTTCAGGAC CAGCCTGGCC ATGAAAATAC AGCCTGGCCA TGAAAACACA CAATAAATTA
81361 GCTGGGCGTG GTGTCACACA CCTGTAATCC TAGCTACTCG GGAGGCTGAG ACAGGAGAAT
81421 CACTTGAACC CAGGAGGCAG AGGTTGCAGT GAGTTAAGAT GACGCCACTG CACTCCATCT
81481 GGGCGACAGA GCCAGACTCT CTCTCAAAAA ACTAAATAAA TAAAAATAAA GTTATGGTAC
81541 ATTGAACTTC TGTGTTCCTT TCTCCCTTAG ATACTTTCAT GGCTACCCAT TTAATTGATG
81601 TTCTTATCAT CTCCAAGAGT TAGTCAGGAG AGGAATCAAC CCAAGCAAAA ATAGCTGATT
81661 TTCTAATTTT CCTTCAATGC CCTTTGGGGT CTTAATCCAT TTGATTTATG TACTTTCAAT
81721 TAATCCTAAC CTCGAATGTC TTCTGCAAAC ATGTTTCCAC AGATGAAACT CGTCAAATGA
81781 AACACATTCC TTTAATTTAT AGAGTTAAAA ATTAGAAAAA TTTTCAATTC TATTTGGCCT
81841 TTAGATTCAG TCTTGCATAT GTTTTCTCAA TTTTGTTCAT GCTCTTTAGT TTGTTTTAT
81901 TCCATCACAA TTGTTCACAT AGCTTACTGG CTTAGGTCTA ATGAACCATT CATTTGGAAA
81961 TTAAAATTGG CCATTTTAAG ATGAAAAGA TTCTTGCCTC AATTTTACTT AGTTTTTGAA
82021 ACTGTCAATG AGGACACATG TTTTTCTGTA CTCTTAGATT CACTAAGTAG TGTCTTGCAA
82081 ATTTAACTGA CAAAGGACAG ATTAACATGC GAAAAAAAAA GCATGCAATT TTATTAGTAT
82141 ATTACATGCA CAGAGTTCCC AAAGAAAAAA AAATTGAAAC CTTAAAAACG CGGTTAGACT
82201 CACAGACTTA TACACCATTC CAACAAAGGA AAGGGAGTTT GCACTTCATG GGATGACGAA
82261 TTTGGGAATG TGACAAGGAA ATAAATACAT GGGCAATAAA AACCATGGAA GATAAAATGA
82321 AAGATAGAAA TAATTGTAGT AAGGTTTGTT TTTGCAGAGT CATCTCAGTG CCAACCTTCC
82381 ATATCTAGTG ATAAGAATTG CTCTCTTTTT CCTGGTATAG CAGTTGGGA CACTTTTACA
82441 AGGGAAATTT CTGTCACCTT CACAAAGGGA AATTTGGGTA AAGAGAAGAC AGAGACCTCT
82501 TCCTACACCT GTTGATTTC AATTGCCTTC AGCTGAAAAT AACTTTATG CCAAAGTAGA
82561 ATAATTTGGG GGTGACATCC TGATATTCTT CAAAACTTAT ATTTAATTTC ACATTAGTAA
82621 TTATATCATT TTTGATTTTT AAATTAGTTT TATAAAATAA TTTTGAAAAA CGGTAATAAT
82681 ATTCAAATAA TTCCAGAAAC ACTGCTGATA AGCCAAAAAC ATCAATGAAT ATTGCATAAA
82741 CAACTGATAA TTCAACCATG AAAATTTATG ACATTGTTCT TGTGTGATAA AACTATGAGT
82801 AACATAAAAA CTAGAGGCTA CTTGTAATGC ATTATTCCAA ACTTTCTGTT TTTTATTTAT
82861 TTATTTATTT ATTTGAGAC ATAGTCTCTC TCTGTCACCC AGGTTGGAGT GCAATGGCGT
82921 GATCTTGGTT CACTGCAGCC TCCACTTCCC CGGTTCAAGC AATTCTCCTG CCTCAGCCTC
82981 CTGAGTAACT GGGATTACAG GCACCTGACA CCAAACCCGG CTAATTTTTT TGTATTTTA
83041 GTAGAGACGG GGTTTCGCCA TGTTTGCCAG GCTAGTCTCG AACTCCTGAC CTCAGTGATC
83101 CACCTACCTC GGCCTCCCAA AGTGCTAGGA TTACAGGCGT GAGCCACCAT GCCCGGCGCA
83161 TTATTCCAAA CTTTCATACA CAGTGCTATC ATGGCTACAA ATTGAAGTAT CATATTATAC
83221 ACTCCTAGGC AAAGCTCTGG ATATTTGGC TATATAAGCC TGAGGGAAAT GTAGTAAGGA
83281 CATTGTGGTT GAAATTCATA CCAGAGATGA ACAGGCCCAG TGCAAGACAG AATTACATCA
83341 CTAAAGGATA TCAGAAGAGA ATAGGGATTT AGGGTACAGT GGCAACAACA GTTTTGGGAA
83401 CTAGCATTTT TTGAGCACTT ATTTACAATA TGCCAAGCAC TGTTGCTGAT TACTCTATAT
83461 TTATTTTCAA ACACATTCTT GTCACAGCAC TTTGAAGTAA GTGCCATTGT CATTCCCACT
83521 TCAGGGTGAA GGACTAAAGC TTGGTGTCAT TAAGGATGTA GCTAGTTAGC TGTGTGTGTG
83581 TGTGTGTGTG TGTGTGCATT TTTTTTTAAA TTTAAAGTCA ATAAATTTTT ATTTGAAGAA
83641 TTTCACATCA AGGTAAACTT TGTTCCTCTA AAGAGCTGGA GTCAAATGT ATCTTCAAAA
83701 GATTCATCTT CAAGTTAGCC CTTCTTAATA GAACTGATGC TTAATCCACA GTTGTCAGCC
83761 CACAGTTCTT TTATTTTGAC TTTTTTTTTT TTTTTTTTG AGACGGAGTC TCTCACTGTC
83821 ACCCAGGCTG CTGGGCAGTG GCGTGATCTC GGCTCGCTGC AACCTCTGCC TCCCGGGTTC
83881 AAGTGATTCT CCTGCCTCAG CCTCCTTAGT AGCTGGGACC ACAGGCGCAT GCCATCGTGC
83941 TCGGCTAATT TTTGTATTTT TATTAGAGAC AGGGTTTCAC TATGTTGGCC AGGCTGATCT
84001 CAAACTCCTG ACCTCATGAT CCGCCTGCCT TGGCCTCTCA AAGTGCTGGG ATTACAGGTG
84061 TGAGCCACTG CACCCGGCCT TATTTTGCCT TCTTTAATCT CCATTTGAAC ATGGACATAC
```

```
84121 TGATGAAAAC TACAACATTC TTCACCAAAA ATCTTTGGGA TTTAATTTCT TCAACCACTT
84181 TACTTTGGGG TCATTTTAAG ATTAGGTGTA TCTGCCTGGT TCTCAATTTG ACACCCTTTC
84241 TCTCTAAACA TGAATGAGTT CCAATCATAT TTATTCCTAA GCTATCACAC TCAAATATAC
84301 TACAGATCTG TGGAATATGC CAAAAGTTAA GGTGAAAAAT TAAATTATTA GGTATTTCAT
84361 AGTTTTGCTA GTTTTGATC TGTGAGTGAA TATAACTATC CTCTATGTCC TGGCACTGTT
84421 CCTCAGAAAC ATAGGGTCCA CATATGTAAT TTTAAATTTT TTAATAGGCA CATTTTAAAA
84481 AGTGGAAAAA GAAATCTATT TTAATGATTT GAATCCAGTG TAACCAAAAA TTGTTTCAAC
84541 AAGGTATCTA ATATTAAAAT ATTGAGTTTT TACTTTGTTA TTTTACTAGG TCTTTGAAAT
84601 CTGGTGTGTA TTTTACACTT AAAGCACATC ACAGTTTGGA GTAGCCACAT TTCCAATGCT
84661 TAATACTCAC ATATGGTTAG TGGCAACTAT CTTGGACAGG ACAGCTTTTA TACTCTGGGA
84721 AGACACAAGC AAATACTTGC TCTGCAGCAG AATCCAGATG TTTTCCAAGA AAACACTTTT
84781 TCTGACCTGT TCGTGAAACC CAGGTAGTGT CTCTAATACT TTATATTTTA TTGGTTTGTC
84841 CTATTGTAAC CACCCAACGG GCTCTCCTTG TCCACTTCCT AGACAGAGCT GATTTATCAA
84901 GACAGGGGAA TTGCAATAAG GAGCCAGCGC TACAGGAGAC TAGAGTTTTA TTATTACTCA
84961 AATCAGTCTC CTTGAGAATT TGGGGACCAA AGTTTTTAAG GATAATTTGA TTGTAGGGGA
85021 CCAGTGAGTC GGGAGTGCTG CTTGGTTGGG TCAGAGATGA AATTATAGGG AGCCTAAGCT
85081 GTCCTCTTGT GCTAAATCAG TTCCTGGGAG TGGTGGGGTG GGGGACTCAA GACCAGATAA
85141 TCCAGTTTAT CTATATGGGT GGTGCCAGCT AATCCATTGT GTTCAGGGTC TGCAAAATAG
85201 CTCAAGCATT GATCTTAGGT TTTAAAATAG TGATTTTATC CCCAGGAGCA ATTTGAGGTT
85261 TAGAATCTTG TAGCTTCCAG CTGCATGACT CCTAAACCAT AATTTATAAT CTTGTGGCTA
85321 ATTTGTTAGT CCTGCAAAAG CAGTCTGGTC CCCAGGCAGG AAAGGGGTTT GTTTCTGAAA
85381 GGGCTGTTAT TGTTTTTGTT TAAAAGCAAA AGTATAAACT AAGCTCCTCC CAAAGTTAGT
85441 TAATCCCAAA CTCAGGAATG AAAAGGACAG CTTGGAGGTT AGACGTTAGA TGGAGTCGGT
85501 TAGGTAAGAT CTCTTTCACT GTAATAATTT TCTCAGTTAT GATTTTGCA AAGGCAGTTT
85561 CACTGTCCAC TTCACCTCAC ATCAGGCCTC TGACTAGAGG ATTCCAACAA TACTTAGGCC
85621 AGGACACCAC CATGTCTCCT TATCCACCCT GAGGGATTCC AATTTCTGAA ACAAAGGAAA
85681 CTATATATGA TAGTATGAAA CTATATATGA GAAGGAAATT ATATATGATA ATCAATTTTA
85741 GGGTTATCTT ATTGATTAGA AGATATTAAA GTGTGACACT GCCTGGCAAT GATATCTGCT
85801 GGTAGTAAGA ATTTGGCGAA TTTAGTGAAA TTCCTGAGGC TGAACCTCCA CTTCTGTAAA
85861 ATGGAGACAG TGAGATAATT TGCCTTACAA TGCTGAAGTA AGAATTTTAC ACAATAATTC
85921 AGACCAACCA CTTCATGTGG TACTTGGCCC GTGGAAGACT ATCAATGACA GTTAGTTTAT
85981 AGTTTATACT ATTAATGAAT CCTTTGTTTC ATTGTTATTT CCTTCTACAC GTTGGCCTCT
86041 CTAAAGAAG GTAATATTCA ATACAAATAA AGTTAAAACA GCTTGCAGAG TTGTCCCAGG
86101 GAACTCACTT AACCACTGAA GTGTTCAAAT TGCTTAAGGT TGACTTTATA TTCTCCTGAC
86161 TAACCTTTCT CCTTCTGGTA TTTCTTCTGA GAACAGCACC ACCATCCAAA GCATCATGCA
86221 AACAGTGGTC ATCCCAGACC AGTAATTCTC AACTCACAGG GTGCTCCTGC AGAGATGTAT
86281 TTGAATAGAG TGGTAGGATG CTGAAGAAGG CCACGTAAAA TTTGGCCAGT GATCTGGGGC
86341 AGATTTATCC TGAAGCTAAT GAAACACAAG TGTAAGGGCC TGTACTTCCA AGGTGCAGAG
86401 AGGGGCCCTA CAAATGTGTT AGTTTGTCTC TCTCTCTCTC TCTGATTTTA AAATTTGCAG
86461 TATTAAGGTA CTTTAATCAC GGATGGTTCA GGCTGCTATT TTCACTCAAT CCTCCTTTTT
86521 ATTAAAATCA CCATTGTCTG ATTATGTTAG AATCCTGATG AAAATATTTG GAATTTGAGT
86581 AAGAGAAAGT TTAGTTGAAG ATGTATCTAG TATGGGGATA ATAAGTTACG TGATTTGCAT
86641 ATGTGATCAT GTGTACTTCA TTCGTTGCCA GCCAATCTGA CGTAAGAATG GCTTCAAGGA
86701 GGCCGGGCGC GGTGGCTCAC GCCTGTAATC CTAGCACTTT GGGAGGCCGA GACGGGCGGA
86761 TCACGAGGTC AGGAGATCGA GACCATCTTG GCTAACACGG TGAAACCCCG TTTCTACTAA
86821 AAATACAAAA AATTAGCCGG GCGTGTTGGC GGGCGCCTGT AGTCCCAGCT ACTTGGGAGG
86881 CTGAGGCAGG AGAATGGCAT GAACCTGGGA GGCGGAGCTT GCAGTGAGCC GAGATCGCGC
86941 CACTGCACTC CAACCTGGGA GACACAGCGA GACTCCGTCT CAAAAAAAAA AAAAAAGAA
87001 TGGCTTCAAG GAATGTTCCT ACTGCTCACT GGAATAACTC ACCTAAATTC CTGGCAAGAT
87061 GCAGGTCTAG ATAAAATGTT ATGACATCTA AGTATTCAAA ACACATTCCC AGCACTGAGA
87121 GTGAGTGTCT AGTGGAGAGT AGAAACGTAT AGAGCCAGAA GCTAGTCTGG AAAGAATTCT
87181 TACAAAGTTT ACAACTTACA TGTGAAAGGA GCTTAACAGA GGATTTTCCA AATTTGAAAA
87241 CAATCCTAAA AACTTACTTG ACATTACCAA TAATGTGTTT TGAAACTGAA ATACTTCTAA
87301 GTTATGAAGA AAACATATTA TCATCAGCCA CCCTGGAGGA AAGATTGAAT TCTATTTCCA
```

Figure 2 (Page 27 of 74)

```
87361 TTACCTATAG ACAACATTAC AAAATAATTT CGATCTGAAG ATGGAATCAG AGTATTCAGT
87421 CAAAACTACA GGAAAATATA CTTGGTAGTG TCATATTCAG AAGTTAATAA AATATGCTAT
87481 TTTCTGAATT TTGTGATGGC TGTTGTTTTG TCAGCTTTTA TAAAATTGGA ATTTGATTTT
87541 ATTTTCCCAT TATAAATTTA TATTTACAGT CTGCAGTACT TTTGCATTTT TAATTTTACA
87601 TTATAGCTTT TAATAGTTAA CAAGTTGTAA AAGGTTTGAT CCCCAGAAAA CCTTGATCTA
87661 CCCCCTCAGT TAAGTATACT AATATATTTA GAAAATGGAT GAAATCAGCA TTTGAATATT
87721 TTTAAATATT TATTAAAAGA GGACATGGGT AAAAGAGCTT TGCAGTTGCC ACCCTTCATT
87781 CTCAAATTCC CTGGATAAGG ATGACCGCAT AATCTTTGGA TGGTCATACG CAAGTCTTGT
87841 GTATTTGTTA CATAAATCTA TTTAGTGGAC TTTTGGCAGT GTGTACTGAG GCCAGTTTCT
87901 TCCACCTGAG CTCTGACTCC ACCTCCAGCA GCCCAAAACC AATACTGAAT TTGGGGTCA
87961 GCTATTGTTT TTGTGGACTT AGGTAACTAC ACACACATTG TCTTTATGAT AGCTTTAATA
88021 ATACTGCCAT CAGAACTAAA ATTGTCACGT GGATTAAAAG GAGTGACGGT GGTGTCCCCA
88081 GGAGCCTTTC AATATGTAAG TATTTACACA TATACATGCT AAAAAGACCC CTAGGAATTT
88141 TTTTAACAAG GGCAAAACAG TAACTCAGCT TGTTTTCTCG CAGTAAAACC GGTTGAAAAG
88201 GCCTGATAGA CTTGTCTGCA GTTACAAAAC TTGTGTGTAG TTATCACCTT TATATCTCCT
88261 GGAAACTAAC ATAGACAACC GAATGGGTTA CAACTGTTTT TAAGTGAAAT TGTGAGTGGC
88321 TCTGAAAAGA GCCTTTTCAA TGAGGAAGAA ACGGGCAGAC TTATGCCCTT TCCCCACGGA
88381 TGCGACGTGC CAGCTGGATA TCTTTGGGCA TGATGGTGAC GCGTTTAGCG TGAATAGCGC
88441 ACAGATTGGT GTCTTCGAAG AGTCCCACCA GGTAGGCCTC GCAAGCCTCC TGCAGCGCCA
88501 TCACCGCAGA GCTCTGGAAA CGCAGGTCGG TTTTGAAGTC CTGGGCGATT TCTCGCACCA
88561 GGCGCTGGAA CGGCAGCTTC CGGATCAGCA GCTCGGTGGA CTTCTGGTAG CGACGGATTT
88621 CGCGCAAGGC CACGGTGCCC GGGCGGTAGC GATGAGGTTT CTTCACGCCA CCGGTGGCCG
88681 GAGCGCTCTT ACGGGCTGCT TTAGTAGCAA GCTGCTTGCG CGGAGCTTTG CCGCCGGTAG
88741 ACTTGCGAGC TGTTTGCTTC GTACGAGCCA TTTGCAATGA GAGCACACAC AAAAGTGTAG
88801 TGAACTGAGA GCAAGTGGCC TTTAAATATA GTGAGAAACA TTCTGATTGG TCCTGTAATA
88861 TTTCAAAAGT CCCGCGCGAT AAAATCATTG GCTGAAGAGT GACCAGACTG ATTGGTTCAT
88921 TACTAGACAA TCTTATTGGA TGAGTTGCCC CACCGCCCAT CCTGTCCTTT TCGTTTCAGT
88981 TATCTGCAGC GACAAATTGT CTAAAATTCT AGTTCATCCA GTCCCAAAGA ACAGAGTGTA
89041 TAACAAGGTA TCTAAGGATT TTTAAAATGT AAATTCCGAT TCAGTAAGTT TGAGTGGGAC
89101 TTGAAATTCT GCATTCCTGA CAGTCTCGCA GTTATCAAT GCTGGTGAAC ACTCACTAAA
89161 CCACCAGAAA CGTTCAGACT CATGTCGGGA AATAACGCTT ATATTCAGAG AATGAGATTC
89221 CATGCTATTT TGTTACTGGC GAACAGCAAG TTTCCTTGCC CTTTGTTTTC TAAGTCCAAG
89281 TCACATTCCC ACCCTGCCTG TTCTCAAAAT GTCTTATTTT GGTTGGCCTT AAGTTTCACT
89341 TTGTATACTC TAAAATGTAC TTTCTAAAGG AAGGTGTTAT TTTCTCGAAA CTTAACTTTT
89401 TAACACCATT AGGCTAGGGG GGCGGTGGCT CACGCCTGTA ATCCCAGCAT TTGGGAGGG
89461 CGAGATGGGA CGATCACTAG AGGCCAGGAG TTCAAGACAA CCCTGGCTAA AATGGTGAAA
89521 CCCCGTCTCG CATAAAAATA CAAAAACTAG CTGGGCGCGG TAGCAGACGC CTGTAATCCC
89581 AAGTACACAG GAGGCTGTGG CATGAGAACC GCGTGAAGCG GCGGGGTGGA GGTTGCAGTA
89641 AGCCGATATC GCGCCGCTGC ACTCCAGCCT GGGTGACAGA GCTAGACTGT CTCAAAACAA
89701 ACCAATCCAA ACGAAAAGCA AAAAATACCC TAACAGAAGC AAGTTATCAT CCTTTCTTGT
89761 GTAACTATGG ACGGCTCTGA AAAATGCCGT TTCAAGTGTA AGCTACGTTT CTGATTTGA
89821 GTGTTTACTT GACCTTGGCC TTATCGTGGC TCTGTTATTT TGGCAACAGG ACGGCCTGAA
89881 TATTGGACAG GACGCCTCCC TGAGCAATAG TGACGTTGCC CAGCTGCTTG TTGACCTCCT
89941 CGTCGTTTCG GATGGCCAGC TGCAGGTGGC GGGGATGAT GCTGCGGGTC TTGTCACGTA
90001 TGGCGCTGCC CACCAGTTCT AAGATCTCGG CGGCCAGGTA CTGTAAGTAC ACTGGCGCAC
90061 CGGCTCCGAC CGGCTCAAAA TAATTGCCCT TTCGAAAAAG ATGACGGACT CTGCCCTATT
90121 GGGAACTGCA AGCCCGGTAG CGACGAACAA GTTTTGCTT TAGCTCCATT TTCCACGTCC
90181 GCAAATAGCG ACCTATGAAA GCAGCGGAAA ACTGTGAAAG ACAAGCAAGC TGGAATGGCG
90241 CCTGAACAAA TCCTTTTATA CAAACTGCAA GGCTGCAATA GGAAGCTATC CTATTGGTCA
90301 ATTATGTTTG GTGCTTTATC CAATAGAAAA AGATAACATA AATTCCATAT TTGCATAAAC
90361 CCCACCCCTC AGTGAAACCG TGTTTCTTTT GTCCAATCAG AAGTGAGGAA TCTTAAACCG
90421 TCATTTGAAT CTCAGGACTA TAAATACATG GGCTCTGAAC TGTTCTCTGT ACTACTCTGT
90481 AGTGGAGAGT GTTAGTAGCT TTTCTATTCT GTTTAGGAAT AGCAATGCCT GAACCCTCTA
90541 AGTCTGCTCC AGCCCCTAAA AAGGGTTCTA AGAAGGCTAT CACTAAGGCG CAGAAGAAGG
```

Figure 2 (Page 28 of 74)

```
90601 ATGGTAAGAA GCGTAAGCGC AGCCGCAAGG AGAGCTATTC TATCTATGTG TACAAGGTTC
90661 TGAAGCAGGT CCACCCCGAC ACCGGCATCT CATCCAAGGC CATGGGGATC ATGAATTCCT
90721 TCGTCAACGA CATCTTCGAG CGCATCGCGG GCGAGGCTTC TCGCCTGGCT CACTACAATA
90781 AGCGCTCGAC CATCACCTCC AGGGAGATTC AGACGGCTGT GCGCCTGCTG CTGCCTGGGG
90841 AGCTGGCTAA GCATGCTGTG TCCGAGGGCA CTAAGGCAGT TACCAAGTAC ACTAGCTCTA
90901 AATAAGTGCT TATGTAAGCA CTTCCAAACC CAAAGGCTCT TTTCAGAGCC ACCTACTTTG
90961 TCACAAGGAG AGCTATAACC ACAATTTCTT AAGGTGGTGC TGCTGCTATT CTGTTTCAGT
91021 TCTAGAGGAT CAACTGGAAT GTTAGCGAAG ACAAGTTTTA GAGCCAAGGT TAACTTGGAC
91081 GGGGCCGTGC GCGGTGCCTC TTGCCTTTAA TCCCGGCAAT TGGGAGGCC GAGGCGGGCG
91141 GATCACTTGA GGTCGGGAGT TCGAGACTAG CCCGGCCAAC ATGGCGAAAG CCCGTCTCTA
91201 CTAAAATACA AATGATAGAC GGTCGTGATG GCGCTCTTTC TCATCTGTCT TAGCAAACTT
91261 CTTTGTTCCC CCTGGGTAAG CCTTCGGGTA CTATGTATAA TTCCTTTGAT AAGGTCACTA
91321 CTCCCTCCCT GGTCTAGTAC AGGAACTTC CCTTTCTGGA TAATGAAGCA GGTAATGGAA
91381 TTCAGGGTAT AGTGTTCCTG TGGGGTCAT TAGCCGTTAA CTTCTTGTGA GATGCGGGGG
91441 AGGGGAGCAG AAAAGTCTAA GCGACAAAAG GCATGTAGG GATATTTGCT CCTGCAGCTT
91501 GCCTATGCTG TAAATTCTTA CTTCAAGTAT TGAGGAAACA ATAAGCGAAG TCTGATTTCC
91561 CGGGCGCCTT TATACGGAAT ATTTCCCGCT CCACAAAATG AAATCGCAGT AGTTTTGAGT
91621 TATAATTGTT TATCAATGAC AACAGCTATG TAGTTTACAT ATTTCATGCA TCCCAGAAAT
91681 CCAGATTCCC ATTTCCTAAG CCACTTAACG TTCTGATTTC CAGCTCTGCG AGATACAAAA
91741 GGGTTTGGAT TTTGTGCCCT TCCCCATCTG GCGCCACTGC AAAGCTTACT AGGAGGGCCC
91801 CACTTGGAGA GGGAAATCTT TTTCGAGAAG TCCAGGACGC CAAAAACAAT ATAGCTAAAA
91861 AAAAAAAAAA AAAAAAGGCA GGAAGAGCAC TAGTTGAGGA GGAGGACTCA ATGGGCCAAT
91921 TCTGGGGCTG GGGCTGGGGG AAGAAATGCA AGAAGAAAAG ACACTTGTTG ACTGCACAGT
91981 AAGCAGGAGG GGGTGGGGGA ATCGGAGGGG AGTATTTTCA GCGAATTTAT GGGCATTATA
92041 TGTAGGTGAC ATACAGCAGT GTCTTTGGAT GAAGAAATAA AGTTTCTCAA ACAGTTCTTG
92101 TTTTTGTTTT GAGAAAGGGC CTTTCTCTGT CGGCCAGGCG CCATCATAGC TCACTGCAAC
92161 CTCGACTTCC CCAGCTCAAG CGATCCTCTT ACTTCAGCCC CTTGAGTGGC TGGGACTAGA
92221 GAAATGCACC ACCATACCCA GTTAATTTTT TAATTTTTTG TGGAGGCAAA GGGTCTTACT
92281 TTGTTGCCCA GGCTGGTCAA GCGAACTCCT GGGCTCAAAT GATCCTCCCG CCTTGGCCTC
92341 CCAAAGTCCT GGGATTATAG GAATGAGTCA CCGCGCCCGG CCCAGATTTA ATTTTTAAGA
92401 ATCTTTTAAA AGAGGTTCTG GGCGGGTGT GGTGCAGCTC ACGCCTGTAA TACCAGCATT
92461 TTGGGAGGCC AAGGTGGGAG GATCACTTGA GCCCAGGAGC TCAAGACCAG TCTGGGCAAC
92521 TTAGTGAGAC CTTTTGTCTC CACCAAAAAT TTAAAAATT AACCAGGCCT GGTGGCACAT
92581 TTCTGTAGTC CCAAGTACTG GGGAGGCTGA AGTGGGAGGA TCATTTGAGC CTGGAAGGTG
92641 GAGGTTGCAG TAAGCTGTGA CGGACAACT GCACTCCAGT CTGGGTGAGG ACAGACCCTG
92701 TCTCAAAAAT AAAAAATAAA AAAAAATCTG GATGCCACAC AAAATGTCAG TGAACAACTG
92761 TAAGTGAAGC ACTTCCCATC CTAGTACTGT ATATGCAAAC TGCCGTTGTG AAAGTGACGC
92821 TTGGCTTAAA AATCTACATT CTTTTTTAA TTATAAAACT ACCACATCCC CAAAAACAT
92881 TACTAAGGAA TTGAGGCTGC AGTTTAAGAA GCTGATATTT AGGATCTATC TCCGGAGAAG
92941 TGAGACCTGG TAATATAAGC ATTTTCAAAA TGAACTTTTG GGCCAGGTGA GGTGTGTCAT
93001 GCCTGTAATC CCAGCACTTT GGGAGACCTA GTCAGGCAGA TCACTTGAGC TCACAATTCG
93061 AGACCAGCCT GAGCAACATG GCGAAATCCA GTCTCTACAA AAAATTAGCA GGGCGTGGTG
93121 GCATATGCCT ATAGTTCCAG CTACTATAGA GGCTGAGGTG GGAGGATTAC TTGAGCCCGG
93181 GAGGCAGAGG TTGCAGCAAG CCAAGATCGC GCCGCCACAG CCTGAGCGAC AGAATGAGAT
93241 ATGCACCCAC GCCCTAAAAA AAAGCATGAC TCATTAAAAA AAAAAAATTT AGCCGGTCGC
93301 GGTGGCTCAC GCCTGTAATC CCAGCACTTT GGGAGGCCGA GGCGGGCGGA TCACGAGGTC
93361 AGGAGATGGA GACCATCCTG CTTAACACGA TGAAACCCCG TCTCTACTAA AAATACAAAA
93421 TAATTAGCTG GGCGTGATGG TGGGCGCCTG TAGTCCCAGC TACTCGGGAG GCTGAGGCAG
93481 GAGAATGGCG TGAACGCGGG AGGCGGAGCT TGCAGTGAGC CGAGATCGCG CCACGGCACT
93541 CCAGCCTGGG TGACAGAGCG AGACTCCGTC TCAAAAAAAA AAAAAAAAA AAAATTAAAA
93601 AAATATGAAG TTTTGAAGCA GAAATTATTT TGTCGTATGT TCTTTCATAA ATTTTTTGCC
93661 TGCCTGCCTT CTTCCTTTGT TACAGAACTC CAACACTTAC CCAAAGGTAG CTGTTGGGTC
93721 AGGGTTTCTG TACTATAGTC CCTTCTGTGG TGGCCAGAAA TATGTTACAG GAAAGAGGTC
93781 CCCATCCAGA CCCCAAGAGA GGGTTCTTGG ATCCCGCGCA AGAAAGAGTT CAGGGTGAGT
```

```
93841  CCGCAGTGCA  AAGTAAATGC  AAGTTTACTA  AGAAAGTAAA  GTGGTGAAAC  GACAACTACT
93901  CCATAGACAG  AGCAGGACAT  TCCCGAAAGT  AAGAGGAGGA  AGGCATCCAC  CCTAGGTACA
93961  ATACTTGTAT  ATATGGGAG   ATGTGCTCTG  CTACAAGTTT  GTGATAAAGG  ATTAATTTTC
94021  TTAGTTACTA  TATTTTGCAA  GAATCAACAT  TATTATCTTT  AAACAAAATT  AAGAATGCCT
94081  TTGTTCTCCA  GATATAGGGA  TATCTGGACA  CTCCTAAGTC  TGAGTCTGTT  TAGTAAACAT
94141  TATTTATTTG  TTCCCTTAAC  CGTAAACATC  TAGAAGCTAG  GAATGACTGA  CTTTCTGGGA
94201  ATGCAGCCCA  GAAAGTCTCA  GCCTCATTTT  CCTAGCCCTC  ACTCAAAATG  GAGTTACTCT
94261  GGTTCAAGTA  ACTCTGACAC  TTTTCTTCTC  TTTTTTTCTT  CTTTTTTCCT  TCCTTTATTT
94321  TTTATTTTTT  ATTTTTGAAA  TAAGAAATCA  AGAATACTTG  ATGTTTCATC  TAAAACAATA
94381  CCCATAATTG  ATAAGCCAAA  ACAAAAACCT  AGGTCTTCTA  ACTCAAAACT  AGGATGTTTT
94441  GCTGTCTCTG  CTGATACTCG  GCTGATCGTT  AATAGGTAAT  TAACAAACAA  GCCTTGCTAT
94501  GTCCCCCTCA  GTTTATTACC  ATTAGATCAT  ATGCCTACTG  TCAATCATAT  TAATCCACAA
94561  CTATGCATTT  CACAAAACTT  GCCATAAAAA  TTCACAGGTT  TCCCGCTTCC  CTCGAGTTTT
94621  CATTTCCGAA  GGGTCCCATG  TAATATAAAA  CTTATATTAA  ATACATTTGT  ATGCTTTTCT
94681  CTTGCTAATC  TTTTTTTTTG  TTTTTTGAGA  CTGAGCCTTG  CTCTGTCACC  CAGGCTGGAG
94741  TGCAATGGCG  CGATCTCGGC  TCACTGCAAC  CTCCGCTTCC  CAGGTTCAAG  CGATTCTACT
94801  GCCTCGCCCT  CCCGAGTAGC  TGGGACCACA  GATACGTGCC  ACCATGCCCC  GCTAATTTTT
94861  GTATTTTTAG  TAGAGACAGG  GTTTCACCGT  GTTGGCCAGG  ATGTTCTCAA  TCTCCTTACC
94921  TCGTGATCCG  CCCGCCTCGT  CCTGCCAAAG  TGCTCGGATT  ACAGACGTGA  GCCACTGCAC
94981  CCGACCAATC  TGTCTTTTTG  TAGAGGGGCC  TCAAGCATGA  ACTTACTGAT  GGGTGAGAAA
95041  AACAGAATTT  TCTTTTCCCC  TACAATATAA  ACATTAATTG  TAATGTTATC  ATTCAGGACA
95101  TTTTGGTGAC  CAATCTTACA  GAAATTTTAT  CTTGTGCAAG  TCTATGCAAA  CCAATATGTA
95161  AATCTTCTAT  AAGTGAGATT  GTATTTCACT  TTTCTAGTAT  CCTTTTAAAT  TAATAAAAGA
95221  GATTCTAATG  ATTATTTTCA  TTACTGCATT  TCATTGTAGG  GAAGTAGATA  ATTGCCCTTT
95281  ATTCACTGAC  CTTCGCTTTT  TAAAAATTTA  AACCATGTTA  CCATGAAAAT  GCTTTTCAGT
95341  ATTTCTCTAC  ACACAAGATT  GCTGTAAGGG  CAAAAATAGA  GATAGGAATC  ATGCATCCAT
95401  TGATATACAT  ATTTTGATTT  TTAATACATG  TTACCAAGTT  GCCTCCTGAA  GGTCTGTTTA
95461  CACTCTCACC  AACAGGGTGT  TTTTTCCTGA  CTTCCACAAA  TGCTCTTGAA  CAGTGGGTGT
95521  GTTAGTCTGT  TCAAATTGCC  GACATGAACA  ATTAAATCTC  ATTGTTGTTT  TTATTTTTAA
95581  GACAATTATT  GTTTGAGACT  GCACATTTTG  ATAATAACAT  TTCTTCTATT  ATGGTTTGAT
95641  TACTCATGAT  TCTTGCCCAT  TTTCTTTTGG  GATGTTGCCT  TATGTACATT  ATTTTAAATA
95701  GATAGCTCCA  TGTATTAAAA  GATTATTAAG  TTTGAGGGCT  TATGATATGT  CAGTTACATT
95761  TCTAAGATTT  TTTTTTTTTT  TTTTTGAGA   CGGAGTTTCA  CACTTGTTGC  CCAGGCTGGA
95821  GTGCAATGGT  GCGATCTCGG  CTCACCGCAA  CCTCCGCCTC  CAGGGTTCAA  GCAATTCTCC
95881  TGCCTCAGCC  TCCCCAGTAA  TTGGGACTAC  TGGCAAGCGC  CACCACGCCT  GGCTAATTTT
95941  GTATTTTTAT  TAGAGATGAG  GTTTCTCCAT  GTTGGTCAGA  CTGGTCTCGA  ACTGCCGACC
96001  TCAGGTGATC  CACCCGCCTC  GGCCTCCCAA  AGTGCTGGGA  TTACAGGTAT  GAGCCACTGG
96061  GCCCGGCCAC  ATTTCTAAAT  TCTTTATAAG  TATAAATTCA  TTCAATCTTC  ACCAAAACTC
96121  AATGAAGTGT  GAGTACTATT  ATTATCATTG  TTTTACAGAT  CAAAACAAGT  AATACAGTCA
96181  CTTACTGAGT  TCTATACACC  TGGTAATTTT  TTTGTTTCGT  TGTTCTATCA  ATTATTGGGG
96241  AAGGGGTGTT  GAAATCTCTA  CCTTTAAATC  ATGTATGTGT  CTATTTCTCC  TTTCGGTTCT
96301  ATCAGGTTTT  GCTACACATA  TTTTGCAGTT  CTGTTATTTG  GTGCATATAC  ATTTAGAATT
96361  GCTTGTTTTT  CGTATTGGAT  TGACCCTGTT  ATCATTATGT  AATATCCCTG  TCTGTTCCTA
96421  GTAATTTTCT  TTGCTCTGAA  ATATACTTAT  CTGATATATC  ATCCAAAAGA  CCACCAGGAT
96481  GGCTAAAGAG  TAGAAAGGAG  AGATTTACTG  GCAATACTAA  TTTGCAAGCC  AGGAAGAGAT
96541  GGTCCCAGAA  CCTGCCAAAA  TTACTCTCTC  TTTGGGGAGA  AGGAGCAGGT  TGGTTATTTT
96601  TATGCCTCAT  AGGCTATATA  TTACACAATA  GAGTCATACA  TATTTAGCAC  GTTTGGGGGG
96661  ACAGCTATAT  ATATTATGAG  GGGTGCCAAG  TGCATTCACA  ATGGATAAAC  ACGTGTAATA
96721  TACCTCCCAT  GTTCACTTCG  AGGTTAAATT  TTGGTTAAAA  TGAGGTAGAA  TTTAGGTCTT
96781  TACATCACAA  GGTGAACTAT  AGGAACAAAG  TTTACGTGCT  GCCTCTAGCA  GCTGGCTGAA
96841  AATGGCTTAA  GGTCTACAAT  TACGTGTAAG  AATAGAATGT  GTGTCAAGGC  GGTCCTCTGT
96901  CCAATCAGAG  TTGTAGTGGA  CTGGACTGTA  AATCAGAGTT  AGGAGGGCTT  CTGATAGCTC
96961  CTATAGTTAA  GGAATTTAGC  AAGTGTGAGT  TTTTGGTAG   TCTTTGGAAT  TTAGGAATTT
97021  GCCATGCCAG  CCAAGCCATG  AATGCTCTAC  CAGTAGGTAA  CTTTGTTTGC  TTAATCTTAG
```

```
 97081 AGTCTGTCTT AGTTGGTATA GGGGCATCTA TTTTGGTCTT TCAGATCCCA GATATTATTA
 97141 ATACAGATAC TCTTGCAGTT TTGGGCTGAT GTTTATATGG CTTATCTTTT TTGCAGCCTT
 97201 TAATTTCAAC CTGCGTTATG TTTATATTTG AAGTGAGATT CTTGCAGACA GTGTACAGTT
 97261 GTTGTTTTTT TTTTTTTTGA GATGGAATTT CACTCTTGTT GTCCAGGCTG GGGTGCAGTG
 97321 GCACAGTCTC AGCTCACTGC AACCTCCGCC TCCTGGGTTC AAGGGATTCT CCTGCCTCAG
 97381 CCTCTTGAGC AGCTGGGATT GCAGCCATGC GCCACCACAC CCGGCTAATT TTTGTATTTT
 97441 TAGTAGAGAC AGGATTCACC ATGTTGCCCA GGCTGGTCTC GAACTCCTGA CCTCAAGTGA
 97501 TCCGCCAGCC TCGGCCTACC AAAGTGCTGG GATTACAGGT GTGAGACCTC GCGCCCAGCC
 97561 AAACTGTTTT TTTATGGGTG TATTTATACC ACACACATTT AATGCAATTA TTGATATCTT
 97621 AGGGCTTAAG TTCATGAAGG GTAGTGTGGG AACCATAGTC TCTTGGCCCA CTAAATGTTT
 97681 GCCAGAAATC ACTGACAAGG CAGATTGATT AATAGGTGAA AAGGCATTTT ACCTATTGTT
 97741 TAACGTGTCT ATGTGGGAGC ATTCAGAATT AATTACCTAA CTTCCCAATG AGTTATAGAT
 97801 GCTTATATAC CATTTTTAGA TCACAGAAAG AATTGGGGCT TAGATTCTGG TAAAACAGGT
 97861 TATGGGAGGC AAAAGAGGTT TGGCTTGCAA AGGTGGCCTT GTTAGGTAGG TGAAGCCTCC
 97921 CTCAGAAAGA ACAGATGGTA AATGTTTCTT TTATGATTTT TAAGTGTCAG ACTCTCAGTC
 97981 TCTCCTGGAT CTGGGAAAG GTATAGAAAG GTGAGGAGGC ATGGCTGCAT TAATGGAGAT
 98041 TCTCTACAGA TGTAAAATTT TTCCCATTTA AGGCAGCTTT GCAAGCCCAT TTCTGCCTGC
 98101 TGGCCAAGCA GCAGCCATTT CAAAATATGT CAAAGAAATA TATTTTGGGG TAAAATATTT
 98161 TGATTTCCTT TAGACTGGTG GCCTTATAAG AAAAGGAAGA GACACCTGAG CTGACACACA
 98221 TACCCTTGCT CTCTCAACAT GTTATGATGC AGTAAGAAGG CCCTCACCAG ATACTAATTC
 98281 CATGCCCTTA GCTTCCCAGG TTCTAGAACA GTAGGAAATA AATTTCTTTT CTTTAAAAGT
 98341 TAGCCAGTCT GTGGTATTCT GTTATAGTAT CACAAAATGG ACTAAGTAAC TATATTATGA
 98401 TCATCTTACA TGACTGATCC CTCCTACATC ATACACATAC ACAGGCCACA TTTGGAACAT
 98461 TGTTAGAGGT TCCTCTACCC AGTACAAATG TACTACAAAT TATATATGTA TTTTTAAATT
 98521 TTTGAGTATC TTCAATAGTA TATTTCGTT AACTTTGTA GTCAAAATGT CATTATAACA
 98581 TGTATTCAAT ATGCATAATT ATTAGTCAGA TGTTTTACAT TCTTTCTTCA TACTAAGTGA
 98641 TATGGTTTGG ATATTGTCC CCTCTAAATC TCATGTTGAA ATGTAATCTC CAATGTTGGA
 98701 AGTGAAGCCT GGTGAAAGGT TTTTGGATCG TGAGGGTGAA CCCCTCATGA AGCGCACTCT
 98761 TCAGGGTAAT CAATGGGTTC TCACTTTGAG TTCACAAGAG ATCTGGTTCT TTAAAAGAGT
 98821 GTGACACCTC CCCCATCTCT CTCGCTCAGC TCTCACCATA TGATATGCCT ACTCCCTCTT
 98881 CACCTTCCAC CATGATTGGA AGTTTCCTGA GGACTTGCCA GTAGCAGATG CCTGCACCAC
 98941 ACCTCCTGTA CAGCCTGCAC AACCGTGAGC CAAAAAAAAT TACTTTTCTT TATAAATTAG
 99001 TCAGTTTCAG GGATTCCCTT ATAGTAATGC AAGAACGAAC TAACACACTA AGTCTATTTC
 99061 ATATTTACAG AATAGCTCAA TCTGAAGTAC CCTTTTTCAA CTTCACAGTA GCTACTTGTA
 99121 GCTAGTGGGC ACTGATTTGG AGCGTGTTCA AGGGTGAATT GTATTATGCA ATTAACAGAT
 99181 TTTTTTTATT GTTTTCGCAA ACCACGAGGC ATAGATTGTC TTACTTTCTC TGCTCCTGGT
 99241 GTTGGAGTTG TTATTGGGAA ACAACTTATT TTCCTCTTAT ATTTATATGG AATAAATAAC
 99301 CCCCAATATT TCCCTCCCCA ATATCTGCCT TTTGTATGTT TTTTGAAGGC AAGTGCCTAG
 99361 AATTTACTGT TTTGAAGCA CTTACTGAAA GGATTGCCAT CAAGTTGTTT TGCTAATAGT
 99421 ACATGCCAGG CGCTTGTTGG TTTGCTTAAT TCAAGGTAAC TTGGATGAGA AGAAGAGTTT
 99481 TTCTCATCCA TGGCTCAGTG GAGTATAGAT TACTGATATT GTGACTGGAT GTACTCCTGC
 99541 TTTCTAGTCT GAGTTTTTGA AGCTACCCTT AATCTTGGTT TCAATTTTAT CTAGCCCTGT
 99601 ACATATCCAA GGCTCTTTCC AAAATGGTCT ACGATTTGTT TAGGAAGTTA GAATAGCTGT
 99661 ACTTTCTGAA CCACGGTTCC TGACATTTTC TGGACTTCAA ACACATCCAG CATTTTATCG
 99721 AAGTATTTAT CCTTCCTACT TGGCTGGCTT CTTCCTTGCC TTCAGGTCTG AATTCAAATG
 99781 ACATTCTCCT GATGAAACTT TCCATCCTTA TTTCTATTCT TTTTTCTTAT CCCCTTTCTT
 99841 TATTTTTCTC CACAGCACTC ATCACTTATC TCTACATTTT CATTATGTAT TTACCTTATT
 99901 GTGCACCTCC CACTACAAGA CAAGTAGCAC CGTAAGGAAA CAGGTTGTCT GCTTTTTCAC
 99961 TGCTATGCTC CCTGCACCTA GAACACTCTC TGGCACTTAG CAGGTTTTCA GTAAATATAT
100021 GCTGAACTAA TAATGCTGGA TATACATCTC CCTCATGAAC TCTCTAAATC CTTCTAATTT
100081 ACATTGATCA ATCTTCTTTT CCATGTGCTT TTGTATGATT TATTGCTCAA AATCTTTATT
100141 TTGTATGCAG AACGTGCACT GCTATTTAAT CTTCATGTAC GTAAGTCCTC CCTTCTCTGA
100201 GTATAATCTC TTCAGGGCAC TATCTGAGAT AACTTTTTAA CATCTCCATC ATGAATCTTG
100261 TACCTTTTCA AAGAAAATGA GCCAGTGATT ACTGATGTTT ACGGCTATTG TTGAGGGTGA
```

Figure 2 (Page 31 of 74)

```
100321 AGATCATTAT AATTTTGAAA AGGGAAGTTG AATATTGTGA AGGGAAAGAT AACACTAGAG
100381 TCAGAAGACT TGGGAGAAGG CAAAAAACAA ACTAAAAATG AGCACTTTTA GTCTCCTGAC
100441 AGTTTCTCTG AATCAAATCC ATAGTTCTGT GACAGCGTTG GCTTAGAAGC AGATTTTTTT
100501 TTTTTTTTTT TTGAAATGGA GTTTCGCTCT TGCCCAGGCT GGAGTGCAGT GGCACGATCT
100561 CGGCTCACTG CAACCTCTGT CTCCAGGGTT CAAGCGATTC TCCTGCTTCA GCCTATGGAG
100621 TAGCTGGGAT TACAGGCTCC CACAACCACG CCCAGCTAAT TTTTTGTATT TTTAGTGAAG
100681 ACTGGGGTTT CACCATGTTG GCCAGGCTGG TTACGAACTC CTGTTCTCAA GTGATCTGCC
100741 CGCCTTGGCC TCCCAAAGTG TTGGGATTAC AGGCATCAGC CACCGTGCCC AGCCAGGAGC
100801 AGATTTTTTT ACACTCATGT TTCTTTTTCC TTCTGTCATC CTGTTTCAGT ATAAGCAGAC
100861 CACAGATAGA AGTAGTAGAT ACCTCAGAAA TTCCTGGAAT AATTAATCCA CGTTCATCTG
100921 TACTCCATCT GCTCCTATCT CATGGAATAT AAAAGGAAAA ACACCAAGAT TTCCCTAGGC
100981 AATCTGTCTT GATTTTAGGT TCCTCAACAG GAGAGCCAGA CAATGGCTGT AATAATATTG
101041 TCCCGGCCAA GGAAAAACTT CCCCTTTGCC CTCCCAAGGT TTATGGAAAA TTACTGGCAA
101101 AACACAGATT AACTGGAGAA AAGGCATATA TATTTATTTC ATCACAATTT TACAGGAGAT
101161 TTTAGAATTA AGACTGAAAG ATACAGGGGA AATTGCCCAT TTTTATGCTT AGGTTCAACA
101221 AGATAAACAG CTGTATAGGG TACGATCTAA TGCTAACAGA CTGAGTGGGG AAGCCCCGCA
101281 AGGCTTGTCT GTCAAGATTC TTCTTGACCT CTCAGTGCAG CATTTCTTCC TTCTGGTTAT
101341 AGGACAAGAC TCTCTTTTAG AATGGGGGGT CTTATGACCT ACAGGCAAAC AAGGTAGGTT
101401 AGAGTAATAT TTTTAGGTTT TATGGCTGGT TCTAGGGAAA AGGAGTTCTG GTTTGTATGG
101461 CCTACCTTGA GGAGGAATTC TGGTTTCTAT GGCTAGACTT TGGGGAGAAT GGGACTTACA
101521 GACAGGAAGG CAGAAGGTGG TCAGTGAAAC ACTTTTATAA TCATAATCCC ATTTTGAGTA
101581 TTTCTGTGTT ATGGAATGTT TGTTCTCTCA TTTCCTGAAA GATTCCAGAG ACTCCTCATT
101641 CAGTGTTGTG AAAAAGTTCA GGAAATGCAA CTCAAAAATG TGCCACTTTG TTACGCTGAT
101701 TTCTTTGAAC TGAGGGCACC TAGGAAACAG TAAATTCAAG GAAGGGCTTT CGCTGAACTC
101761 TAATCAAAAA TTTGAAAATT AAAAAAAAAT TCAAAAGGA ATTTAGTTGT TAAGATTCAC
101821 TTCCCTGGGG AATCTCATCA ACCAGAGAAG ATTAACTGTA TCACAGGAGA GGAGACTGGT
101881 GGTTAACACC ATCTAAACAG ACTTTGTCAC AGCTGTCACC TATTCTTTGA AACACCCATT
101941 TATTTTTCTC CAAAATCATA TACTCTCCCC TAAGTTGCCT ACATCCCCCT TCTTTCTCCC
102001 TTATGAATCA AGAGAGCTTA TAAGCTTCTA CAGTTCACTG GGATTTGGGG TATTCGCTTT
102061 TCTTCCCTCC CACTCCCCCT CCCCTTTTTT TGTCTTTGAG ACACAGTCTT CTGGCTCTGT
102121 CGCCCACGCT GGAGTGTGGT GGCTCTATGT GAACTCACTG CAACCTCCTC CTCTCGGGTT
102181 CAAGCGATCC TCCCACCTCA GCTTCTCGAG TAACTGGAAC TACAGGCGTG CACTACCAAG
102241 CCCGGCTTTT TTTTTTTCTT TTTCTCCCCC GTTTCTTTTT TGGTTATTTT ACTGGAGACA
102301 GGGTTTCTCC ATGTTGTCCA CGCTGGTCTC GAACGCCTGA CCCGCCGTCC TCGGCCTCCC
102361 AAAGTGCTGG TATTACGGGC ATGAGCCACT GCGCCCGATT TGAAGGACCT CTTAAATATC
102421 TATTTAGAAA TTGGTCGGAG TCCACTCCTT TCCAAAAACA TGAGTCACAA TCCGGGAAAA
102481 GCACGAGCGG CTGAAAGTCA AATAACCAG AACAAAACCT CCACTCATGC TTAAAAAGG
102541 TATTTTGACA AAATCCTAAT TCGGCCAATT ATTATTAGTA TTCAAGTCGA AGGCTCGTCA
102601 AGCCAGACTG GGATTGGGT CAAACATAAA CCTTACACCA GACGGAAGGA TTACATGCAA
102661 ATGAAGGATG CAGATTCTGA TTTCCCATTG GGTATTTGAC ATTAGCCAAT GGGAGAATTC
102721 CTCACAGCCT ACCTCCAGTC AGTATAAATA CTTCTCTGCC TTGCGTTCTA ATGTAGTTTC
102781 ATTACATTTT CTTGTGGCGA TTTTCCCTTC TTATCAGAAG TAGTTATGTC TGGTCGCGGC
102841 AAACAAGGCG GTAAAGCTCG CGCCAAGGCT AAGACTCGGT CTTCTCGTGC AGGTTTGCAG
102901 TTTCCTGTGG GCCGAGTGCA CCGCCTGCTC CGCAAAGGCA ACTACTCCGA GCGCGTCGGG
102961 GCTGGCGCGC CGGTGTATCT CGCGGCGGTG CTTGAGTACC TGACCGCCGA GATCCTGGAG
103021 CTGGCGGGCA ATGCGGCCCG CGACAACAAG AAGACCCGCA TCATCCCGCG CCACCTGCAA
103081 TTGGCCATCC GCAATGACGA GGAGCTTAAT AAACTTTTGG GGCGTGTGAC CATCGCGCAG
103141 GGTGGCGTTT TGCCTAATAT TCAGGCGGTG CTGCTGCCTA AGAAAACTGA GAGCCATCAT
103201 AAGGCCAAGG GAAAGTGAAG AGTTAACGCT TCATGCACTG CTGTTTTTCT GTCAGCAGAC
103261 AAAATCAGCC TAACAGCAAA GGCTCTTTTC AGAGCCACCT ACGACTTCCA TTAAATGAGC
103321 TGTTGTGCTT TGGATTATGC CGCCCATAAA GATGTTTTTG AGGTGTTTTT AATGGCTTTG
103381 AGTGTGGCAC TTTTAGTAAT TTGTCCTGCA GAAATTAGAT CCATAGAAAC CTCAGGAATT
103441 CTAGGTATGT GGGAGAAGTG CCATGCAGCA CAAAACATGT TTACAGGGGT GATTCGCGTT
103501 AAGTTTCACA CACAGCAGTT ACTACATTTT AGAGGAAGGA AATTATACCC ATGAGTGCAT
```

Figure 2 (Page 32 of 74)

```
103561  TCCTAACTAT  CTTGAATGGA  AGTGTTAAAA  CCCGCATGCC  CCACACAAGT  TTGAATATGT
103621  CATACCATTT  GCTGTAGCAA  TTAATGGCAT  ACACAATTGA  GAGCACACAC  ATTACCACTG
103681  AACATTTGAG  TATGTATTTC  CCAAAATGAG  CTTTTTTCCA  GTTTGGGGAT  GTTTTGCTTT
103741  GTTTTGGGGT  GGAGTCTCCC  TCTCGCCCAA  GCTGGAGTGC  AGCGGCGTGA  TAACAGCTCA
103801  CTGTAACCTC  GAACTCGGGC  TCAAGCGATC  CTCTTGACAG  CCTTCTGAGT  AGCTGGGATT
103861  ACAGGCGAGA  GCCGCCACGC  CCGGCTAAGA  GCATTTTTCT  AATTGCCCAC  ACTTCTTATG
103921  CGACACCCAG  AAAAATACAA  TTTTAAATAA  AGCGCATATG  CAAATTTCCC  TAATCGTCTC
103981  CAATATTCTC  TGATTTCTTT  TTTATATTTT  AACTAGAAAC  AATTGGAGGT  TTCCGCGTTG
104041  CTTTGTGTGG  TTGTAAATTT  TAAGACTTCA  GGAAACTTTT  CCAGTACAAG  ACTTGTCCAC
104101  AGTGGATATA  GCAGCTAAGG  GGTTAACAAA  ATGACGTCAG  AGTAGCTACG  GTAATGGGCA
104161  GGAGCCTCTC  TTAATCTGCA  ACCAGGCACA  GAGATGGACC  AATCCAAGAA  GGGCGCGGGG
104221  ATTTTTGAAT  TTTCTTGGGT  CCAATAGTTG  GTGGTCTGAC  TCTATAAAAG  AAGAGTAGCT
104281  CTTTCCTTTC  CTCCACAGAC  GTCTCTGCAG  GCAAGCTTTT  CTGTGGTTTT  GCCATGGCTC
104341  GTACTAAACA  GACAGCTCGG  AAATCCACCG  GCGGTAAAGC  GCCACGCAAG  CAGCTGGCTA
104401  CCAAGGCTGC  TCGCAAGAGC  GCGCCGGCTA  CCGGCGGCGT  GAAAAAGCCT  CACCGTTACC
104461  GCCCGGGCAC  TGTGGCTCTG  CGCGAGATCC  GCCGCTACCA  AAAGTCGACC  GAGTTGCTGA
104521  TTCGGAAGCT  GCCGTTCCAG  CGCCTGGTGC  GAGAAATCGC  CCAAGACTTC  AAGACCGATC
104581  TTCGCTTCCA  GAGCTCTGCG  GTGATGGCGC  TGCAGGAGGC  TTGTGAGGCC  TACTTGGTAG
104641  GGCTCTTTGA  GGACACAAAC  CTTTGCGCCA  TCCATGCTAA  GCGAGTGACT  ATTATGCCCA
104701  AAGACATCCA  GCTCGCTCGC  CGCATTCGCG  GAGAAAGAGC  GTAAATGTAA  AGTTACTTTT
104761  TCATCAGTCT  TAAAACCCAA  AGGCTCTTTT  CAGAGCCACC  CACTTATTCC  AACGAAAGTA
104821  GCTGTGATAA  TTTTTTGTTG  TCTTAACAGA  ACAAATTTCT  AAGGACCCCC  CCGGAAAGCA
104881  TTAGACTATG  GTCTTAAAGT  TGATTAACAG  AAATAACGGT  TTGGTCAGTC  TTGCAGTGTA
104941  GGTTATTTCT  GACCTTATTA  AGGTGCTATT  TGGAGAGAAG  CTGTGTAAGT  CCACTATCAT
105001  TCAGGCCTCT  AGCTTGCTAT  GATTAGCATT  TGTTTAAACA  ACTTTGTAAG  AGTAAGGGAA
105061  AAATCTGGTA  AGTAGTTAAC  TGGCGCTTAC  TAGGCATTTT  TGCAAAGCTT  TGAAAAGATT
105121  AGAAAATTGT  GTCTTGCGAG  TTCCAGTGTC  TTCCTCAAAA  TGCTTAGGAA  GATTTTCTCA
105181  GCTCAATACA  TAGTCCCCTA  GGTTTTCTCA  TATATTATAT  ATATATATAT  ATATATATAT
105241  ATATATATAT  ATATACTGTT  AAATTCATTT  GGCTGTTAAC  ATTAACCTGA  AATTTATTCT
105301  GGTGCAAAAT  GTGAGGCAGG  GATCTAACTG  GCTCTCATTT  TATCCATAGC  TAGCTACCCA
105361  CTTTAAATCT  GTCAGTCTGT  CGACCAAGCA  TAATTTAATC  CCTTATATAT  GAATTTTTAT
105421  ATGTGTGGCT  TTGCTTGTAA  ATAGTCTATC  TGGTTGCATT  GCTTTGTCTC  CTCTAGGACT
105481  ATGCACCATG  ACATGCCACA  TTCTTTTTTT  CAGTACTTCT  TGCCTGTAGT  TATTAAAATC
105541  TAGAATTTAC  AAGTTTTAAC  CATTTTCTTT  CTGTTGATCT  TGCTTTTCGG  TTTTGGAGGT
105601  TGGGGATTGA  GTACTGGAAG  AAAATTTAGA  GGGATGGGAA  TACTGTACGC  AAACAAAAGT
105661  AATATTTACT  TTAAAATTTT  TATATTTTGT  ATTTTTTTAT  CATATAGCTT  TTACATCACA
105721  TTTTACAGAC  TAACTTTAGA  ACAACCACAG  AATGTCCAAC  ATTAAAACTA  CTAATTCCAA
105781  AGACCTTGCC  TCACATTCTT  TTTTACAATA  AATATTTTTT  ACACCTAACA  TTCTTTCTTG
105841  GCCTACATCT  AGAATGTAAA  CTGATGTACC  ATACTAAAAT  CGCCTGACCA  ACTGTCAACA
105901  ACAACAAATC  ACACACACAA  AAGATCAAAT  TTGAATTGCA  TCGTTTACTT  AAATTCATTT
105961  GTGTTCCAGC  TTTTAATAAG  GCAGTTTTTG  GTTTATAAAG  TAATATTTGC  ATTTTAAAAA
106021  TTATGAAAAT  GAATATGTCA  GTTTGTTTTA  TGATTCGTTT  TTCTTGACTC  TTATACAAGC
106081  GACTCTAACT  GGCATAGACA  TTTGTTATCC  ACAGACAGTA  TAGATATGTT  AGAGATGCCA
106141  ATGGACTTGG  TCTATGCCAA  GGTGACTACT  CACAAGCTCT  GGGCCCAGCT  GAAGGTCAAG
106201  TATTTTTTTT  CCAGTTATAG  ATGTGCTGGA  TCTGATGTAT  AGCGCTTGAC  TTTTTATATT
106261  TTCTTTATCT  GTAGGAAACA  AATGTGTTGG  AGGTACTGGG  TCTGACGAAT  AGCATAAAAG
106321  AATAAAGTTA  CATTACTGTC  TGAGGATCAG  ATGGACAGGG  GGTGGTAGCT  CAGTCCAGCT
106381  ATTTTCCACT  CCCTCACTTA  CATTCTTTGC  CCCTCCTCA   ACAGAACAAG  GATTCTGCTG
106441  TAACTCTTCA  TTGACAGTTG  ATATTTAAAA  ATTAACGAAT  GGATGAAATT  CTCATTTGTG
106501  AAAGAAATT   TATTGAGCAT  TTTGTATTTG  TGAGTAGTGC  AAACATTTTA  ATATTATATT
106561  AAGAATCTAT  TGTTTTGTAT  TAGAGGAGTA  ATTAAGGAGA  GATTGGAGAC  AAAAAGGGGG
106621  TGTTGTTTGC  AGAATATACC  ATCCAAAAAT  AGACCACTGT  GGGATCAGGA  TTCTTTTGAG
106681  CTAAAGGCAC  TTCAAAAACA  GCATTCAAGA  AGGGAATTCT  TCTAAACTTT  TCTTTCTGAA
106741  AACAGGAGAT  AAAAGTTCCA  ATGTGAAAAA  TGCTCTGCTT  GTACCAGGTG  AAAAGACATA
```

```
106801  TTCTTCAGCC CAGAGGCATA GATGAGATAA TTCTGCACAA ACACAGCAGG GAGTCATAGC
106861  CGAGAGACTT CTATACACAA ACAAACCTTG TTAAAATAAT CATATATTCC TTTAATCTCC
106921  TCATATGGTT TACTTTCCCA CAATTGCCTC TCTTTAACTT AATGTGAAAG CATTTAGCTT
106981  TTGCCATTTC TTTGGGGCTT CACTTTTTTA TGAGGGTTCT CCTGTCCCAT AAAATTTACA
107041  TTAAATACAT TTGTATGCTT TCATTCTGCT AATCTGTTTT ATGGCAAATG AATTATCAGG
107101  TCCAGCTGGA GACCCTAACA GAGTAGAGGT AAAATTTTGC CTCCCTACAA GATAGAGATT
107161  GTGTGCATTA AATGTTGTTT GTTCCCAGTT GTTCAGTTTG TCAGGCCTCT GAGCCGAAGC
107221  TAAGCCATCA TATCCCTGT GAACTGCACG TATGCCTCTA GATGGCCTGA AGTAACTGAA
107281  GAAACACAAA AGAAGTGAAA ATGCCCTGTT CCTGCCTTAA CTGATGACAT TACCTTGTGA
107341  AATTCCTTCT CCTGGCTCAT CCTGACTCAA AAGCTCCCCC ACTGAGCACC TTGTGACCCC
107401  CACCCCTGCC AGCCAGAGAA CAACCCCCTT TGACTGTAAT TTTCCACTAT CTACCCAAAT
107461  CTTATAAAAC GGACCCACCC CATCTCCCTT CGCTGACTCT TTTCGGACTC AGCCCGCCTG
107521  CACCCAGGTA GAATAAACAG CCTTGTTGCT CACACAAACC CTGTTTGATG GTCTCTTCAC
107581  ACGGACGCGC CTGAAACAGT TTAACAGGGT TTTTCCTGCC CAGTCACAAC AAAGTGATGT
107641  TATGCTGCAG GCTGAAGTTT ACAGCTAATG CTGTTGAAGT CTAAAATCAG TTTTGGTTTG
107701  TTAGATTTGG GTGAGATGGC TAAGATTCTC AGAGAAAGAA GTCAAGTTTG GGGTGCATTT
107761  TTCAGACTTA AAAATTTAGC AGTAGCCCTT GCAGTTTTTC CAATAGAAGT GATTTACGAA
107821  TGTTTTCAGG AAATTTAAAA CAACAGTGAG AAGCGTGTAT GGAGAGTTGA ACTACACTCC
107881  AGACTTGGCT ATAGGAAAGC ACGAATGCTG CTATTGTATT GCACCTTGGA AAAGAGAACA
107941  AAGGAATATT TTCGGACAAT TTTAACATGT CACATATGAA AAGCTAAACG GAATCTGTCA
108001  ACACCTTGTA CGTTATTACA GGCTGTGATT TTAAAAAAC AATCCTTACT AATACATACA
108061  TAGTTGCTGC TAGCAATATA GTGTTGGGAG TAAAAACACG AAAATGAGAG TTCAGGACAA
108121  TATCCCAACT CTGAGCAGAT TTTTTTAAGT AGTAACATCT AAAATTAAAC CATATTATGT
108181  AATATTTATT TCTTTTCCAC AGTCTCTTCT CATGCCTCGT TCACATTAGC TAATTAAAAG
108241  TCCCCTGAGT ATCATCATAA CCCGATTTAC AGATGAAGGC ACGGTTGCAA TGAGCTATCA
108301  CCCTCTTCTG AATGAGACAG TACAGTGTGA AGGATAGCAA AACTCCACTC CCATCCTCTT
108361  AGGGCTCTGG CTGGACCAGC AAATTAAATT AATGTAAAAT GGATTAACAG GAGAAAGGTA
108421  TATGCATTTA TTTAACACAG GTTTTACGTG ACACAGGTGC TCTCATAAGG TAATGAAAGC
108481  CCAAAAAAAG CAGTTAGCTA CTTATATAAT GAATTGGACA ATTAGTAAAA TGTAAAAATG
108541  CGCTAAAGCA AAGGGATTTA GGCTAGAATA TATAACTGTG TAGAGAAGCG CCCAGCAAGG
108601  GCTAGTGCAA GGTTTGTACA GAATTCTCTT GGCCTCAGCC TCCTATCCTT GAGAAGAATG
108661  TTGCTTTTTT TAAACTACAG TGAGAACATC TTTCATATGA GAATTTCACC TACTGCTTCT
108721  AAGAAACAGG TCAGCTTTCA AGAAAACATA AGGCCAGAGT GATCTTTTCA CGCCTGCTCT
108781  TTTAAGTACC TTTGAATAGT CAATATGTCT TCAAGCACTT GAAAGACTTA AAAAGTTTAC
108841  CACTCCGGCA TATTAGTGAA AGCCCTTAAT ATAAGCCCTT ATTAAAATTC TCAGTCGAGG
108901  GTATAAATTC AGATTCAAAT AGTAGTGTCG TAAACGGGAG GGAAAAACTA AAGGGATTAA
108961  AAAGTGAAAC TATTGTGTTC TCCCTCGCAG TCCTTAGGTC ACTGCCCCTC GAGGGGCGGA
109021  GCAAAAGTG AGGCAGCAAC GCCTCCTTAT CCTCGCTCCC GCTTTCAGTT CTCAATAAGG
109081  TCCGATGTTC GTGTATAAAT GCTCGTGGCT TGCTTTCTTT TCGCGTACCT GGTTTTTGTT
109141  GTCAGCTGGT TAGACATGTC TGGTCGCGGC AAAGGCGGTA AAGGTTTGGG TAAGGGAGGT
109201  GCTAAGCGTC ACCGAAAAGT GCTGCGGGAT AACATCCAAG GCATCACCAA ACCGGCCATT
109261  CGGCGCCTTG CTAGGCGTGG TGGGGTTAAG CGAATTTCCG GTTTGATTTA TGAGGAGACT
109321  CGTGGCGTTC TCAAGGTGTT TCTGGAGAAC GTGATCCGGG ACGCCGTGAC CTACACGGAG
109381  CACGCCAAGC GCAAGACTGT CACTGCCATG GATGTGGTTT ACGCGCTCAA GCGTCAAGGA
109441  CGCACTCTGT ACGGCTTCGG CGGTTAATCT TTTCGTCAGT TTTCTTCCAA TGGCCCTTTT
109501  TAGGGCCGCC CACTCCCTCT CAGAAAGAGC TGTGATTGTA TTCTTTCGGA TGGTAACATC
109561  TCAATGGCTT TACTCGGCTA TTCTGCCTAG TATGTAGAAC TATTATAAAC CAGTTGGGAG
109621  AGACCAGGTT GTTTGGTCTG AGTGGCTGCT AAAGCAGAAA TCAGCTAAGT AAACGAGGTC
109681  TCCGAGATAA GTGAGCTATA AACTTCAATG CTATAGTTTT GACATGTCAA GCAACTTAAC
109741  GTGCAGCGCG AGTCCGATAA ATGAGTAGCT CAGCTTTTTA GTTTTAAAAA CGAGTTGTGC
109801  GTTATTTGTA CGAGAGCCTA AGATGCTAGC TGCCTGGAAC TGAGTAGGTG GATTAAAATG
109861  GGTGTCAGGT CTGTTTTCCC AGGCGTATCT GACTTAACGT CAGCAAAAGC TGTACTTTTA
109921  GCTTCCCTGG TAACACCTGC CGTCCTTAAC CGCCCCTGC CGGTAGCGCC AGAAGCCTTT
109981  ACTTCCATTT CTAGTTGAGC TTGGCGTCCT GCTGAGTGAC GTCACCTCCC CCTTCTGTGG
```

```
110041 AGTAGGACTG GCGGTTAAAG CTGCTTTGCT ATTTTCAGTC CTCAGGCTGG AGGCTCCCCT
110101 AAGCAGGCTG CCTACGCAGT TCGTAAATTC CCACTTAGTA GACTAAGGGA GTCTGTTTTA
110161 TAAATAAGGA CTCAAATTTC TTCTGACTCC GAGGTCCGTG GCAGCAGCTA TAAGATGGAA
110221 GCCCCCTCTG ATGTAAGATT CTCAGATGAC TTGCATCTTC ACTGTACCTG TCAACCCAAT
110281 AGTCTTCTAT TCCTGCCTTA AATTGTAAAT TCCAAAACTG ATTTAATTGT GAAAGTTTCA
110341 AACTGTACGA CCTAGGAAGT GTCAAAGTTA GGTGACCAGA TTTTTAGAAG TCAGCCAAAT
110401 ATTCAGCATC TTTGATTTAG TAACAAATAT ATTGATGGCT ACTTCAGCAA AAAAAATCAA
110461 CTTTGTTTTC TGGTTACTTT GCTAACAAGC TTCTCCTGAC AGGAGGATAT AGTGAATAGG
110521 CAGTTGAATA AGTGAGTTCG GGTGAGAGGT CTGAGCTGGA GATAAAAATG TGTGAGTCAT
110581 CAGCAGATAA ATAAATGCTG AGACCAGATG AGATGGCTAA AAACTGAAAC ATAATGTAGT
110641 GCAGCATTGT TTGTAATAGT AAATGAGTGG CAACTGTAAA GTTTTCATCA GAAAGGACTA
110701 GAGTGATCTA TACATCCATA AAATAGAGTA TTTCTCTACA CAGCCCTACT AAAGAATGAG
110761 AAAGCTGTAC TCCACTACAT ACTCTGGTGT ACTCTGGCTC AGTTCTTGGA CTCCTCTTTT
110821 CTTGGCTAAC TCAACTGGCC TCACCACTTA CATGCTCTGT GCTCTGTCAA ATAGTTTGTT
110881 CAACAGAACA CCACGGCCTA GCTGTAAGTG CCACGTTAAC TTCTAGCAAT GCCAAAGCCT
110941 GTGATAGTGG CAGCTTCGGG CTGTTTCTCA TTCCCGGGAT GCCTAACCAC CTCTCCAAAT
111001 TCTATCAGTT TGCTTCCACC CACTTCAAGC TTCAGAACGA AACATAGAGC TTAAGAAATA
111061 TAGGCCCGGC AAGGTGGCTC ACGCCTGTAA TCCCGGCACT TTGGAAAGCT GAGCCTGGTG
111121 GATCACCTGG GGTCAGGGGT TCGAGACCAG CCTGGCCAAT ATTGTGAAAC CCCGTCTCTA
111181 CTAAAAAAAA AAAAAAATTA GCTGGGCATG GTTGCGGGCG ACTGTAATCC AAGCTACTCG
111241 GGAGGGTGAG ACAGGAGAAT AGCTTGAACT CGGGAGGCAG AAGTTGCAGT GAGTTGAGAT
111301 CGCGCTATTA CACTTAGGCC TGGGAGACAA GAGTGAAACT GTGTCTCTAA ATAAGTGTTT
111361 GCAATTATAA ACCATCTCCC TGACCTTAAA TCTCTAGACT CATATACAAC TGCATATTTG
111421 ATGTATCTAA TTGAATAATG GGCATCTCGA ACTTGTCCAA AATATGTTTA TACGTAAACA
111481 CCAAGTCTGT TCTTCCTCTG ATATTTGTCA TGTCAATCAA TAGAACTCCA TTCTTCAAGC
111541 AGCTTGGGCC AGGAATTGTG CAATATTGTT TGTCCTGAGC TTCTTACAAC TTTCACCCAA
111601 TGCAGTCAGC TCTGTTGAAA ATCAATCAGA ATACCTTTCA TTGTTTTCTT TGCTGCTTCT
111661 CTAGGAGCAA GCTGCCATGG CGGTTTGTCT GAATGACCAC AGTGACCCCA AACTGGTCTT
111721 TGTTTTCACT TTTAATCCCC CTGTCATACA GTTTTTCTCT ATCCAGCATC AACAGTGATC
111781 CTTTTTGAAG GTATTATGTC CACTGTCTGC TGAAAAGATT CCACTGGCTT TCCATCACCT
111841 TCATAATAAA AACCAGCATC CTTATCATAG CCTACAAGTA AGATGACCAA CCATTACAGT
111901 TTGCCTGACT CTCAGGGGTT TCTCAGGGTG TAAGACTTAC AGTGCTGAAA CTTAGAAAGT
111961 TCCAAGCAAA CTAGGATGAG CTGCTCAACC TACTAGATCT GTACTCTGGC TACCCTCTGA
112021 CCTCATTCTC TTCGCAGTTC TTTCTCTTCA CTGACCTTGC TGTTTCTGGA ATGGACCAAG
112081 CATTTCCAGC ATCAGCACCT TTATATCTAT TCTTTCTCCC TAGAAGGGTC TTGTCCTGGA
112141 TATCTGAATG GCTCTAGATC TCATTTCATT CAAGCCTCTC CTCAAATACC AACCTTAAGA
112201 AAGAGACCTC CCATAATCAT CCCTTGTAAA ATAAGCTTTT CTGCTCATTT AGCATATATA
112261 TATATAGTTG ACTATCCTCA ATAGCATATA TATATAACAT TTCCCCACCT AGAATTATAT
112321 ATGTAATAAT ATATTTAACA AAAAATACAT ATAACTAGAT ATATTTATT TTGTGTTTGT
112381 TCTCTCTCCC CCAACTGGAA TATATTTTTT GAAGGTAGGG ACTTTGTTTT GTCCCAGAAG
112441 TATCCCTAGC ACCTTGAACA GGGCTGACGT TTAACAGGTA GTTTATGGAG GTTTGTTGAA
112501 TGAAAGGATG TGTGAATTTT CTATGTAAGT CTCCAGGCTC TCCACTAAGC CCACCAGAAT
112561 GCTAACACAA TCAATTCCCC ATCTCATTCC TTGACCTGCC ACTGCCTGAA GCAATCAGCG
112621 TGCAGTTTCT CTTTAGAAAA TCTGGGGGAT AGTCTAGGGG TTGCAAATTA AGCAACATTA
112681 TCTTTGTTCT GAACAAGGAC TGCATGAGTG TTAGGACTGA AGAAGGCCCA AGGTGGTGGT
112741 GGGTATGCCT AAGATGAGTA TGACATATCA GCAATGCTAT GAACATAGCA ATGCTATGAA
112801 AGGCCAGGCA AAACGTAACA GGAGCTAGTC GTGGCTTATT GTTACAACGA CTATACCTCC
112861 CATATGGGTA ATCGATATCC ACACACCCCT CTACATTGAC TCTGGAATTC AGGAAAGGGA
112921 ATTAAATTTT TCTAACTTAT GTACCCCAAT GATTTCAACA ATATCTGGCA TATGAGATCA
112981 ATAAATATCT TTAAATACC AACTAAGAAA GACATAAAAT GACCCACCCT CCATACCAGG
113041 CTCATTTTTG CTCCTCTGAT TCCTGAAACT ATCCAGAATG CAGCTATGAA TTCTCTCCAT
113101 TGTCAGTTTT AAATTAAGCC AAGCTGGGTA CTTGTGTAAT TCCTCAAGAA ATCCTGGATG
113161 AAAACTGTCA GGTGGAAAAC AGGACCTCAA AATAAAGAGA CATCCATCAC TGAAGCTAAC
113221 ATCGTGAGGC TGAAATCAGT CCTATAACAA TGGTACCAAA AAGAGCACAA TGAGAGGCAT
```

Figure 2 (Page 35 of 74)

```
113281  TTGTGAATAT TTACTCAGAT GAGAGTAAGA TATTTCCCTA TCAGCTAACC TGAAGTTCAC
113341  ATCCCTTTTC CAGCTGAGTT CTGAAGCTAG ATGTACTTAA CTGGAACACA TAACTGCATC
113401  AGGAACATCC TTTAAAACTA TGGCTACAAT GGCTTGACTG GACAAACCCC AGGCTTCCAG
113461  GTTTAGCACA GGTGGCCCTT CACAGACCAA CATTGCCTAT GCTACCAACC TCATGTCCTA
113521  CCACCCTGCT TGCATCATTT CTCTCTCTGC ATATATAAAA ATATATGTGT ATGTATATAA
113581  TCAGCTTTAT TGATATTTAA TATACCACAA AATTTGCCCA CTTTAGGTAC AGTTCAATGA
113641  ATTTTACCGT GTTTTCTTAG TTGTACAACC ATCATCACAA TTTAATTTCG GAATATTTCT
113701  ATCACCCAAA TTTCCATTTC TGCGTAAAGG GGGAAAAAAA AAGGTTAACT GCTGAAGGCC
113761  GCGGTAACAC TGAAAAAGGT GCCTTTTCTC TCTAAAACAG ATTTTAATCT CCCCTGAATT
113821  TAGTGTCCTG GGTATTCCAG GAGTCTGAAT AGGGTTTCAA TTTTCAGGGT CTTTTTAATA
113881  GAGTAAAACT GTATTGGTGG CGATAAATTT AGTATTGCTC TCAGTACATG ATTGAGGGAT
113941  ACTTAAATGT CTCTGTGATT TTATTTCATA ATCGCTAAAA GATGGTTTTT TTTTTTCCTA
114001  AAACAGGGTT TTTGTTTTTT CTCAATAAGC TTCTTAGCTT CCCCTCCGGC TCCCTGGCTT
114061  GCCTCAGGAA ATATTAGCTC ATCAGTTCTG ATTGGTTGAC AGCTACGAAT GGCCCTCATT
114121  GATTGGGCAG CGCTTCTTTG TCCCTTGGAA ACTAATACAA ATTTTTAACA CTACTTTTTT
114181  TCCACTCTTT CTTCAGAGTT GGAATATCGT TGCTCCCCTA CCCATATGTA GTGAGTGGAG
114241  GGCAAACTTG GAGTTCCCCT AATCTTTCCT TTTTAGGATG TCAGCTCAGT ATCATTCATC
114301  TTAATTACAC ATTGAGCTTC TTGACTTAAT GGATACAGCT CTTCTTTTGT TTAGTTGGGC
114361  GGCCCTGAAA AGGGCCTTTG GTTCAGAAAT GCAAGCTGTG GAGAAATCAG CAACCTTAAC
114421  CGCCAAAGCC ATAAAGGGTG CGTCCCTGCC GCTTAAGCGC GTAGACCACG TCCATGGCAG
114481  TGACTGTCTT GCGCTTGGCG TGCTCCGTAT AGGTGACAGC GTCACGGATC ACGTTCTCCA
114541  AAAACACCTT GAGCACCCCG CGAGTCTCCT CGTAGATCAG ACCAGAGATC CGCTTCACAC
114601  CGCCACGCCG GGCCAGACGC CGGATGGCCG GCTTGGTGAT GCCCTGGATG TTGTCACGCA
114661  ACACCTTGCG GTGGCGCTTG GCACCCCCCT TACCCAAACC CTTCCCGCCC TTACCACGTC
114721  CAGACATGAC TTCCCAAGAA GTGAACCAAG AGCAAGTGAG AGAATAGGAA ACCGATCTTT
114781  ATATATCTAC GTTACCCCTG CCCCCACCTC CAGCGGACAC AGAGACTGAA AAGCGCGCAG
114841  GCGGGAAATG TGACGCCTAC AGTCCGCTCC TTTAACCCCT CCTCCAAGCC CCAGGAAATG
114901  GCGGGAGCAG CGATTGGGGG AGGGTGGGGA GATGAGGGTG GGACCAAGCA GGCTTGACCA
114961  ATGGCCTTTA TTTTCTTAAC AGAGCTACAG GCTTTGAGGA ACTGGGTTAA GAATTAAATG
115021  TAAACCCATT CTGACTCCAG AATTATTTTA AGTCGAACTT TTTTTTTAAC CGAATCTCTC
115081  TGTCGCCCAG ACTGGAGTAC ATTAGAGCCA TCTCGATTCA CTGAAACCTC TGCCTCTCAG
115141  GTTCAAGTGT TTCTCCTGCC TCAGCCTTCA GAGTGTACCT GGGATTACAA GCGCTCGCCG
115201  TCGCGCCCGG CGTGTTTTTG TATTTTTCGT AGAGACGGGA TTCGGCCATG TTGGCCAGGC
115261  TGATCCCGAA CTCCTGATTT CTGGTAATCC GCCCGCCTCA GCCTCTTAAA GTGCTTGAAT
115321  TACAGGCGTG AGTCACCGCG ACCGGCCGAA ATCGATTGGT TTTGAAGCCT TCAGTAGCAT
115381  TAAAACGAAA AGTGCTCCCA ATGCATTCCC TTTTGTCTTA AATTGGTTTC TTACAGCTAC
115441  TTTACTTGAA AAGGTGGTGG CTCTGAAAAG AGCCTTTGCT TGGACCGTCA GAGAGACCAC
115501  AGTAATCACG CCCTCTCTCC GCGGATGCGG CGGGCGAGCT GGATGTCCTT GGGCATGATA
115561  GTGACGCGCT TGGCGTGGAT GGCGCACAGG TTAGTGTCCT CAAATAGCCC TACCAAGTAG
115621  GCCTCGCACG CCTCCTGCAG AGCCATCACA GCGGAGCTCT GGAAACGCAG GTCTGTTTTA
115681  AAGTCCTGCG CAATCTCGCG CACCAGGCGC TGGAAAGGTA GTTTACGAAT AAGCAGTTCA
115741  GTGGACTTCT GATAACGGCG GATCTCGCGC AGAGCCACGG TGCCCGGCCG GTAGCGGTGG
115801  GGCTTTTTCA CGCCGCCGGT GGCCGGAGCG CTTTTGCGGG CTGCCTTAGT GGCCAACTGT
115861  TTGCGTGGCG CCTTGCCACC AGTAGACTTC CGAGCAGTTT GCTTAGTGCG AGCCATGACG
115921  GAAAAACAGC ACAGCGGAAC ACCCAACACT AGCGCAAATA CGCCCATGAG CTGCTCTATT
115981  TATAGTGTGT AAAGTGCAGT GATTGGATGA TAGAAGACGC TAAATATGAC GTTACACACT
116041  CTGATTGGTC TATCTTTAAG CCAGCAACAA TCGTGCAGTT TCACCGGCTA CTATATTCTA
116101  TTCCAACTCT ACAGATGATT ATTTAAGTGG TATTTTATTA CTACTATTAT TTTATTTTAC
116161  TTTTGCTTTG TTCCCCAAGC TGGTCTTAAA CTTGGGCTCA AAAGATCTTC CCGCCTCAGC
116221  ATCCAGAGTA GCTGGGATTA CAGGGGAGCC CCACTGCGCC GGCTTGGACT TTAATTTTTT
116281  AAACTTGTCC TCTTCTACAT CTGGTTTTCA TAACCTGAAG GCTGTGTTTA TTTTCCATAA
116341  AACAAGGCAT TGATTCCAAA GGTATTATAA TTCCCCAATT CCGTATAACC TTCAGCTCTT
116401  TAGGAAAAAA AAAAAAAAAA AAAAAGAGG GAATACTGCT CACCTCCTCT CCGGAAATGT
116461  ACCCTTTACG GGAATTTCTG AAACCTTTCA CAAGAATTGG ATTCCTTTGT AATGCTTTAA
```

Figure 2 (Page 36 of 74)

```
116521 TTGACTTAGG AGTGTTATTG AAATCTACAA AGCATCTCAA ACATAGTAGG ATTACACTAT
116581 TACTCAGAAA CATTTTCTAT GAGACGTCTT TCTCTTGATT ATGCTCTTTG AATCCTAAAC
116641 TTGCAGCGTT CTGCAGCTTT TGTTTTCTAA AGCCTAGGTG TACTCTGCCA GTCACAAAAT
116701 GGCGTTTCTC CAGCACTGCC GCCAGGTACC ACCAGCTGGG AGTTGTTCCT CTTGCGGAGC
116761 AGGAGGTGGA CTTGGCCCAA GAGAAACTGG ATAGTGGTTC GCAAGGAACA TAATTTAGCA
116821 TTGCCAAGAG CTAATGCAAT CATTTTGAAA ATCTCAAAAC ACTGAAAAGT GGATTGTGAC
116881 CTTTTTAAAT TCACAAGAGA CAGGCCACAT TCTATCTTTT GATTGGTTTA GGCTATTTTC
116941 TTGAACAGCC ATTTAGAAAG CAGATCTATC ATCCTTCATT TGCATGGAGC GTTCCCATTT
117001 TATTTGAAAC CAGTTTAACC CAATAGAAAA AAGGGAGGCA GAACCCATTA TTTAAAGTGG
117061 AAACTCCTGA ATCAGATAAT TAGGAGTATT TCCTTTTCAA AAGTTGCGTT TTTTCAGATA
117121 CCTCGCTTAT TACACTAAGA AAGGTTTATA TCTTTCACAA AGGGTTTACT TACAAAAATC
117181 TTCCAATTTT GTATACCTGT GTTTCATAAC TGACTAGCCG TCAAACCAAG ATGTAGAGTT
117241 TCCAACCGTT ATTTTCCAAA TTTTTAGAAA TTACGTGAAA TATTTGAATG CATGCCTTCT
117301 CAATAAAATG GGACGTAGGA AGCACTGGTG CAGAAGATGG GTACAATACT TATCTGGGAC
117361 CACTCCATTA TTTGGTTGGC ACGTTGTTTG AAGAAAAAGG GGAAAAGCTC AGGTTACTTA
117421 GCATGGTTCG GACTTATTTG AAAACTACCA CAGCAGGAGC GGAAATAAGA CCGCATTACC
117481 TCACTCTCTG CTGTGCTGTG CTAGGGGGTT ATCCAGAATA GGATTGTAGA AGTGGATGTC
117541 GATTTAATAG TTTTTTATTC TCCCATTAGC TGAGTCTCTG ATTGGCAATG TGAGATCGTT
117601 TTAGCTTATT GATACTTTGA AATGCACTTA ACAGCCACAA ACAAGTTAAA GGGTTGTTAC
117661 CATAAAATCT TATCCCCAGG GTGTGCTTGC ATTTATCACC CGTGTTTGCT TTCACACTAA
117721 GTGGACTTAA CTCCCCAGCA GAATGCCTGT CAGGGAACCG GTTTCGTGGA CCCAGCATTT
117781 AACGCCTTTC GCAGGCTTGT GAGGCCCATA AATATTTGTT GAATAAAAGA ATGAGTTGAC
117841 CATGTCATGG TGCGCTGATT GCGTGTGCTG ACATGGAACA CAGGTTGTAA ACCTTAATAC
117901 CAATTTGGGG CATGTTGTAT GGATGAAAAG GGCATTGGAA ATTCCTGAAG TGCATCCCAC
117961 ATTGGACTGT GGAAATAAGT TGCAAGTGCA GAAACGTTTC CACACTTGCA GTTGAGTAT
118021 TAATTGCAGC GTTTGTGAAT TCTGGTGTTG TCTACGATTC ATTCTTGTTT GACGTGAAAG
118081 GTATTCGCGA GACACATCGC TCTAAAACAT TGCCAGAAAA TGTAATAGAG TTGATGACAA
118141 CTGGCCCTAA CACGGCCTAA AACTCGCACT TTTCTCTCCC TCCGCAACTA TTCAAAACAC
118201 TGTATTTTAC ATTTCTTGCA AATTAAAAAC TAACATCTCT GGCAACGGAC CTCTAAAAAT
118261 TTCTAATAAA ACTCCTCGGA TGCTTGTGGC ACTGCATTTG TAAACCGCCC CCTCTCAACC
118321 TACTCCCTAA AAAAGAGCTG CTTTTTGAGA GAGAAGCGGT ACCCTCTGAT GTTACTGGGC
118381 GGCAGTCTGC CTACAATTTC CTTCACAATG AGGCAACCAG AGCGGCTTTT TCTGTGTGTT
118441 TGCTTGCGTT GAGGGGAGCA GGACCATAGG CCCTAGAGGC CCCCAGCTGC CTTCTGAGAC
118501 TGGGCGAAAC CCTCGGCAGC GCGCAGGGGG CGCTAGGGCG CGAGGGGCGG GCACTGACGG
118561 GCACCAATCA CGGCGCAGTC CCACCCTATA AATAGGCTGC GTTGGGGCCT TTTTTTCGCA
118621 TCCTGCTTCG TCAGGTTTAT ACCACTTTAT TTGGTGTGCT GTGTTAGTCA CCATGTCTGA
118681 AACAGTGCCT CCCGCCCCCG CCGCTTCTGC TGCTCCTGAG AAACCTTTAG CTGGCAAGAA
118741 GGCAAAGAAA CCTGCTAAGG CTGCAGCAGC CTCCAAGAAA AAACCCGCTG GCCCTTCCGT
118801 GTCAGAGCTG ATCGTGCAGG CTGCTTCCTC CTCTAAGGAG CGTGGTGGTG TGTCGTTGGC
118861 AGCTCTTAAA AAGGCGCTGG CGGCCGCAGG CTACGACGTG GAGAAGAACA ACAGCCGCAT
118921 TAAGCTGGGC ATTAAGAGCC TGGTAAGCAA GGGAACGTTG GTGCAGACAA GGGTACCGG
118981 AGCCTCGGGT TCCTTCAAGC TCAACAAGAA GGCGTCCTCC GTGGAAACCA AGCCCGGCGC
119041 CTCAAAGGTG GCTACAAAAA CTAAGGCAAC GGGTGCATCT AAAAAGCTCA AAAAGGCCAC
119101 GGGGGCTAGC AAAAAGAGCG TCAAGACTCC GAAAAAGGCT AAAAAGCCTG CGGCAACAAG
119161 GAAATCCTCC AAGAATCCAA AAAAACCCAA AACTGTAAAG CCCAAGAAAG TAGCTAAAAG
119221 CCCTGCTAAA GCTAAGGCTG TAAAACCCAA GGCGGCCAAG GCTAGGGTGA CGAAGCCAAA
119281 GACTGCCAAA CCCAAGAAAG CGGCACCCAA GAAAAGTAA ATTCAGTTAG AAGTTTCTTC
119341 TAGTAACCCA ACGGCTCTTT TAAGAGCCAC CTACGCATTT CAGGAAAAGA GCTGTAGTAC
119401 ACAGATGAAA TCCCCAAGC AAATGCAACA CGCCCTCAAT TATATTAGAA TCACTTGGAG
119461 AGTCGATAGA ACTTTAACAT AGCCTCATCT AGTAAGAATT TACTACTCAA TCTATCAAAG
119521 ATAGCAAGGT GAATTCAAAT GCACCGAGTT AAAATCGAGT TTTAAAGTCA CCTGGGTTTC
119581 GGTAGCCGGA AGTCCCGCGT CTCACGACTC CAAGCTAATT AGTCATAACC GTATTGAACC
119641 AAGGTTGAAG CCCAGTCCCA GGCTTGAGGC TTTTTATTAT ACAAGGTTAA AGTGGGGATA
119701 TTGCGTTTTG GGGTCAATAT TGCTAAAGTA GCATTTTCCG AAATTGGGTG GTCCTAAGAA
```

```
119761 ATGCTTCTGG GATAGTTGGC AAAATATATG GCTTAACCAC GCCCTCTCCA CAGGAGTGGC
119821 TAGCGAGCTG TCTGTCCTTG GGAAGGACGG TGACCCTGCT GGCGTGGCTG GCGCCCACGT
119881 TGGCGTCCTC TGAAAGCCCC GCCAGGTAGG CCTAGCTCGC TTGCTTTCTG CAGCGCCATC
119941 ATGACAAAGC TTTGAAACGC AAAATGCTTT CTTTGTGCAG CGCCTTACCA TGGGTGCACT
120001 TACGGGCTGT CGACTTGGTT TAGGCCCTTG TCAGGACAAA GGAGCTTAGT TTGTTGGAGT
120061 TTTAGAGCTG CAACCCAAAA TCCCTTGCTC GGTTTCTCTG TTTTTAGAAA CGGAAGCGCC
120121 CTGATTGGAT ATTTGAAAAT TACTGTGCTT AACTGGATCG TGTTTCATCA ATCGTGCAGG
120181 ATTTTCAACC CTGGTGGAGC CCACACATTC AAAACTGAAG ATCCTTTTCT CAGAACTGCC
120241 CCTTTAAGCT TTTGCAATTT TAATTCTGGG GGTCAGATTT TAATAATTGG ACTTTTTTGT
120301 TTACATCTGA CAAGAGTATA TGATGAGCCA AGTTTACTCA CTTTTACTTA GTGCAGTTCA
120361 ATTCTAAAAG TTTATTTTTG CGTGTGTGCA TATGAGTTAA TAATCAGTTG TATTTTTCAA
120421 ACGGTCTTTT TTCAATTGTT TTGCTTAGCT CCTTCCATCG TCTAAAGTCA GGGATACAGG
120481 CACATCACAT CCCTGTTCCC CCTTCCTCAA ACTAATATGT AGCTACCTAG GTTTATCCTT
120541 TAAAACAAAA ATTCTCACCT ATTTTGTGA GAAATATACA TGTTTTTCTT TGAACTAAGT
120601 ATTTTACATA CACCTATCTA TATACATGCA TACTTGTGGT TTTGTTTTTT TAAAAAAAAA
120661 AAAAAAAAAA CACGTTATCT TTTGAGACTG GGTCTCAGTC TGTTGCCCAG ACTGGACTGC
120721 AGTGGCATAA TCACAGCACA CTGTAACCTC CAACTCCTGG GCTCAGGCTA TCCTGCAGCC
120781 TCAGCATCCG GAGTAGCTGG GATTGCATGC ACGCACCACC AAGCCGGGCT TTTTGTTTTT
120841 ATTTTTGTG GAGACAGTCA CACCATGTTG TCCAAGCTGG TCTAGAAATG GCCTCAAGTG
120901 ATCATCGACC TCCCAAAGTG TTGGGATTAC GGTCACTGTG CCTGGCCTTG TATGCATAAT
120961 TGTTTTGTCT TTTGATTAGG GTTATTAATT TAAAAAACAA AGCCTGGACG CAGTGGCTCA
121021 CATCTGTAAT CCCAGCACTT TAGGAAGCCG GATGGGCAGA TTACTTGAGC TCAGGAGTTC
121081 AAGACCAGCC TGGGCAACAT GGTGAAATCC CATCTTGACA AAAAATACAA AAAATTAGCA
121141 AGGCCCAGTG GCACGCACTT ATAGTCCCAG CTACTTGGGA GGCTGGGGTG GAAGATGAC
121201 TGGAACCTGG GAGGTAGAGG CTGCAGTGAG CAGAGATCGT GCCACTGCAC TCAAGCCTAG
121261 GTGACAGAAT GAGACCCAGT CTCAAAACAA AATAATAAA AATTTTTAC AACGATGTTA
121321 TATACACTTC TGCATGTTGC TTTTCTCTTA ACCAAACTTT TCTAAAACCC TGTCATGAAA
121381 AAAGAAATCC TTCACATGGA ATAGCATAAG TTATTCATCC ATTTCTTATT GATAAGCATT
121441 GATGTTCCA GTTACCACTG CTGAACATGG TGCAATTGAA TAGAATTCCA GGGCTGAGAT
121501 TGCTAGGTTT TAGGTTGTAT TTTATTATTT TATTTATTTA TTTATTTATT TAGACAGAGT
121561 CTTACTCTGT CACCCATGGT GGAGTACAGT GCCATGACCT CAGTTGCAAC CTTTGCCTCC
121621 TGAGTTCAAG CGATTCTCAT GCCTCCGGTC TCCCGAGTAG CTGGGATTAC AGGCACCTGC
121681 CACCAGGCCT GGCTAATTTT TGTATTTTTA GGAGAGATGG GGTTTCACCA TGTTGGCCAG
121741 ACTGGTCTCA AACTCCTGGC CTCAAGTGAT CTGGCCACCT CGGCCTCCCG AAGTGCTGGG
121801 ATTACAGGTG TGAGCCATGG CTCCAGACCT GGACTTTGTC TTCTGTTTCA TCAGTCCTTC
121861 TGTTGGTTCA AGCACAGTAT CACACTGAAG ACTGATGATT CTATATAAAT ATGGTAAAGA
121921 CTGTACACCC TAACTGTTCT TATTTTTTAA TTTTAAGGCA ATTTTAGATT CCAGCTTTCC
121981 AAAGAATTGT GGAATGCTTA GAGCTAGAGA AGCCTTGGAA GTCATTTAGT TTTTGTTTTG
122041 TCAGAGAAAA TTCTGTAGAG ACTCTGTCCT GCTCTCACTG AATACCATCC CATAGTACCC
122101 CCCAACAGCT TTAAAGGGCA ATAATACCTT ATGGACAGTA TGCTTTTCCT CAAATATATT
122161 CTAAGCCATG GTCAATGCAA AAGAGTGAGA AGGAAAGTAG AATAAGTTAT CTAAGAATCA
122221 GTGGGTGCTC TCTTTAAACT GATTTATCAC TCCCCCTTCC AAACTCTCTT GAAGGTCACT
122281 CTGCCTCCCT TTCTACATAA GAACTCCTAA CTCCAAGGGA GGAAGGTAAG TTATTCTTAT
122341 TCCTTGCTTA GAAAAGAGA AAATAGGTTT GGTAAGCATC CGCTTTCTGC TACCATTCTC
122401 TGTGTTTCTG TGTTTTTTAT AGGATCATTC AATTATTGGT TGGCTCTTGA GAGGGAATGC
122461 AAGGTTCAAG GACACAAGCC TAGATCTTGC CTGTATAGAA CCTCATGATG TTATGCTTCT
122521 CTAAAATGAG GCCTGGAGGA GACATGTTGA AAGTGACCCA TAAATCTGCA GTATCTCATG
122581 TCTCTCAATG GGGACAAGGA GTACCATGGG AAATAGCATT AGGTCAATGA CAGTAACAAC
122641 TCCCAGGTGA GTTGATTTAT TCTTTTATTT ATAAAGTTGT TAATATGCTA CATAGTCCCT
122701 AATTTTGCCA CAAATAGTCA TTATTTAAT TTCATATTTC ACTATTGATA AATGAAGGAA
122761 AAAATGAGTA GCAGTTAAGC AGTCCATAAA CCTACATATA AAGCAAATTG GAGATTTTAA
122821 AATTGATTCT GGATGCTTAA AATCCTTCTC ATTGAAAAAA AATTTCGTAT TAGAAGATTT
122881 CAACATTCTT TAAACTGAGA AGCATAACAT ATAAACAGAA AACCACAGCA AAACAAAAAT
122941 GCAAAGCTCA ATAAATGAAC ACAAAGTGAA CACCATAATA ATTGCCACAC AAGTAAAAAA
```

Figure 2

```
123001 ACAGAAAATC AGCCAACCCT CCCAGAGCTG CCTGATGCTT GCTTCCAGTC ACATTATCAC
123061 TCCATCTGCC CTAAACATAA CCCCTATTTT GATTTCCAAT GCTGTAATTT AGTATGCCTG
123121 TTTTTGAAAC ATATAAAATG GAAATAAAAC AAATGTAATC CTATGTACCT GACATATTTC
123181 ACTCCAGAAC ATTAGGTTTG AATAGATTCA TCTGTGTTGC TGTGTATAAC TTTAATTCAT
123241 TTTTATTGTT ATGTAATATT CCATGTTATG AGTGCAACAA TTTAGGTGTC TACTGTTGAT
123301 GCATATTTGC TTCCCTTTTT CAGCTAATAT AAACAATACC GTGAATATTC CTGTGTATGT
123361 GTCTTGGTAT ATATAGGAAT ACATATTTG TTTGTATACC TAGGAGAGGA ATTGTTGGGT
123421 CAAATGCTAA ACTCTTTTTG AAAGTGGTGA TATTAGGTTT ACATGCGATG AAATGAAAAT
123481 TAAAACCACA GTTATAAACA GCATGGATGA ACCTCACAAA CCTAATGTTG ATGGAATCTA
123541 GCTGGGAATT CCTGTTCTTC CATATACTTC CCAATATTTT TTTCCAATTA AAATTGTTAA
123601 TCTTTTGAAG ATGTTATCCA TTGTGGCAGA TGTGCAGTAT TATCTCATTA TGGTTTTATT
123661 TTACATCTTT TGCCCATTTT TTCTTAATTG GATTGTATAT CAGTCGACTT GGGCTGCCAT
123721 AACAAAAATA CTAGACTAGG TAGCTTGAAC AAAAGGAATT TATTACCTCA CAGTTCTAAA
123781 GGCCAGGCCA GAAATCCTAA ATTGAGGTGC CAAGAGATTC AGTTTCTAGT GAGGGCTCTC
123841 TTATTGACCT GAAGATAGTT GCTGTCTTAG ATTGTTTGGT GCTGAACAGA ATACCAGAGA
123901 CCAAATAATT TATAAAGAAT ACAGATTTAT TTCTTACAAT TCTGGTGGCT ATAAAGCCTA
123961 TGGTCGAGGG GCCCACCTCT GGCAAGGGCC TTCTTACTGT TATGGCAGAT GTGAGATGTC
124021 ATCTCATATT CAAACCACAG CAGTCGCCTT TTGTGTCCTC ATGTGGCCTC TTCATATGCC
124081 CATAAAATGA CCTCATGTCT CTTCCTTTTC TTATAAGGAC ACCAGATCTA TCAGACTACT
124141 GGCCTACTCT TATGACCTCA TTTAACCTTA AATATCTCCA TAAAGTCCCA AAATCCCTAT
124201 CTCCAAATAT AGGCACATTG GGTGTTAGAG TTTCAACATC AATTTTGGGG AACACAATT
124261 TAGGCCAAAA AGATTGTGTT TTTTCTTGTT GGTTTAAGAT AGCTGTCTTT TTGTCCTTTT
124321 TGTCCTTTCT TTTTTTTTGA GGTGGACTCT TGCTGTGTCA CCCGGGTTGG AGTGCAGTGG
124381 CGCTGTCTCA GCTCACTGCA ACCTCCACCT CCTGGGTTCA AGAAATTCTC CTCCTCCCAA
124441 GTAGCTGGGA CTACAGGTGC ATACCACCGC GCCCTGCTAA TTTTTGTATT TTTGATAGAG
124501 ACGGGGTTTC ACCATGTTGG CCAGGCTGGT CTCAAACTCC TGACCTCAGG TGATCCACCT
124561 GCCTCGGCCT CCCAAAATGC TGAGATTACA GGTGTGAGCC ACCAAACCTG GCCTGTCTTT
124621 TCTGTTTTAA GTTTTTAAAT TTTGCTCACG AACCCTTTAT CCATTTATG TGTTGCAGGT
124681 ATTTCCTCTG TAACTTGTCT TCACTCTGTC AGAGGCTGGA GTGCAGTGGC ACAATCACAG
124741 CTCACTGCAG CCTCCACCTC CAGGATCAA GCGATCCTCC CATCTTATCC TCCTTAGTAG
124801 GTGGGACTAC ATGTGCAGGC CACCATGCCC AGCTAATCTT TGTATTTTTT TGTAGAGATG
124861 GTGCTGTTGC CCAAGTTGGT CTCAAACTCC TGAGCTCAAG CAATCCATCA ACCTTGGCCT
124921 CCCAAAGTGT TGGGACTAGA GGTGTGAGCC ACCACTGCAC CCAGCCAATG ATATCTCATG
124981 ATGCATTAAA GTCATTAATT TAGTGTACTC AAATTAAGCA CACTGCCCTT TTATGCACAA
125041 CCTTTTTTGT ATCTTATTTA AAAAATCATT TTCTATTTCA AGGTCATGAA GATCTTATTT
125101 TATAATACCT TCTTGTGAAA TTAGTTCTCA AGACTACCCT CACTTCTAAC ACCAATTATA
125161 AGTTGGGAGG TCTGTGGTTC CCAATCAACC TTAGGTTAGT AATTTGCTAA AAGGACTCAC
125221 AGAACTTGCT GAAGCTGTTA GCCTCATGGT TACAATTTAT TATAGGATAT ATAGCTTATT
125281 ATGTCATTCC AATGCAATGT AAAATTATAC AACTACTTTT AAAAAGATTT TAGCATTTGA
125341 CCCAACAATT TCACTCTGAG GTATACAAAC AGCAGATATG TGTGCACATA TATACCAAGA
125401 CACATACACA GCAAAATTCA TTGTTTGTAA TAGTTGAAAA GGGGAAACAA CTCAAGGAAT
125461 AAAGATTAAA ATCAGCTGAG AAAAGAAACA CACAAGGCAG TATTATGGAT CGAATTGTAT
125521 GCAGATCTCC CTTGCCCCA GAAGATATGT TTAAAGTCCC AACTCCAGT ACCTCAGAAT
125581 TGTGGCCTTA TTTGGAAATA GGATAGTTGC AGATATAATT AGTTAAGATG AGGTTATAGT
125641 ACAGTATGAT GGGCTGGTGA CTTAGAAGAA GTAGTATATA TATATTTTTT AATAGAACTA
125701 GTATTCTTCT AAGGTGGTCA CGTGAAGACA GACACACACA GGCAGAGACT GCGGTTATGC
125761 AGCTGCAGGT CAAGGAATGT CAAAGGTTGC CAGCAAGTAC GAGAAGCTAG GAAGAGTCAA
125821 GGAAGGATTT TCCTACAGGC TTCAGTGGAA GCATAGATCT AATGATACCT TCATGTCAGA
125881 TTTCTAGCTT CCAGAACTAC AAGAGAATAT ATTTGTTGTT TTAAGCCACC CTAGCTTCTA
125941 GCTCTTTGTT ACAGCAGCCC TAGGAAACTA ATATAGGCAC AATCCAGGCA AGTTCCAAAT
126001 ATGAGCTTCC AGTTGTCCTC TCCCAGTAAT ATGAACAGTA TTACTTTCCC AGCATTAATG
126061 TGTGACAATA CACATGACGT ACAGAGCAGT CCCCACTTAT GCACAAAACA TATGTTCCAG
126121 GACCTCCAGT GGATGTCTGA AACCATGGAT AGTACTGAAC TCTATATAGC TGTTTTTTCC
126181 TATACAGACA CAGCTATGAT AAGGCTTAAT TTATAAATTA GGCACAGTAA GAGATTAATA
```

Figure 2 (Page 39 of 74)

```
126241  ACAATAAATT AGAATAATTG TTAAGAATAT ACTGTATAAA AGTTAGGTGA ATGTTTATTT
126301  CTGAAATTTA CCGTTTATTA TTTTTGGACT GCAGTAGACC ACAGGAACTA AAACCATGTA
126361  GAAACCGTAT ACAAGAGAAC TGTATTTCAC CCGAGCCTCA GTGTGCAGTT TTAATGGCCT
126421  GCCATGGTTG ACTGCTCACA TGGCCGATCT TTTAGTCTAC CTCCACAGGT AGAGCTGATA
126481  CTGTGTGGCT CAAAGTTCCT ATTATAAATC ACATTGTTGA CTGTGTGGTG GTCAAAACCT
126541  CCAGGTAAAC AAAGACACAC TTATCAGTGA GAACATTTCA AGGGTCTAAA ATTCATCTCC
126601  CAGTAGCTGA GGGCAAAGGC TAGACCTCTT TTTGGGTAAG ATAAATTTTT TACCATATAC
126661  TTTATTTTGC TTTTCATGTT TAACTTTATT TTGCTTTTCA TGTTAGTTCC CCTGGAATTG
126721  TTTTTTGTGT ATAGTGTGAA GTAGGGGGTC AAGTTTCTTT TTTTTTCCTT TTTGTTCTTT
126781  TTCTGTTTAA AAGGCTATAC AATTGTCCCA TGCCATTTAT TTACAAGAGT CCTTTCACCA
126841  TTGTTGTATG GTGCCACTTT AGATGTAAAT CAATGTCCAT ATTTGTTTGA GCCTGTTCCA
126901  TTCGTTTGTC TATTTTTGGA CAACACTGCC CTGATTATTG TCATTTTATC AGTTTTGATA
126961  TTTAATAAAG CAACAGATTT GTTTATTTTG GGCCCTTGGA TTTGTGTATT AAATTTGAAC
127021  CCTGTTTGTC AATTTCTATA ATAAAGCTTA TTGGGAATCT GATTAGGATT ACAATGGTTT
127081  TGTAGATCAG TTTGGGGACA ATTAATACCT TTAAAATATT GACCGCTTCA ACTGTAAATA
127141  TACTCCTCCA TTATTTAGTT TTCCTGTTTA ATTTATCTGA GTAATACATT ATAGTTTTCT
127201  TCGTAGAAGT CAGATACGTA GAAAATTCAA AGCCCAAGTG CAATAGCTCA TGTCTGTAAT
127261  ACCAGCACTT TGGGAGGCCG ATGTGGGTGG ATCACCTGAG GTCAGGAGTT TGAGACCAGA
127321  CTGGCCAACA TGGTGAAACC TCATCTCTAG TAAAAATACA AAAATTAGCT GGGTGTGGTG
127381  GCGGGCACCT GTAATCCCAG CTAATCAGGA GACTGAGGCA GGAGAATCGC TTGAACCCAG
127441  GAGGCAGAGG TTGCAGTGAG CCAAGTTCCT GTCACTGCAC CCCACCCTGG GCGACAGAGC
127501  GAGACTTCGT CTCAAAAAAA CAAAAAAAAG AACATTCAAA TAATCAATGT AGATAATTCA
127561  AATAACTAAA AAATGAACAG TTATTAAAAT ATCAGGATAT AAAAGCAAAA AAATCAATAA
127621  CCTCCATATA TACAAAATGG CCAGTTAGAG AAAAAAAAAA GAATAGGCGA GACTTAAAAA
127681  GGCTGGGAAT CTCCCTGAAA ATCTTTGAGA GCCTTGGCCC TGCCCTCAGG GATTTCTCTG
127741  GCTTCATGCC CAGATATGGG TACAGTTCCT TGTTTAAAAA AATTTTGCTC CATCAATCAA
127801  CAAGGGGCTC CTTCCTCAGA GCACAAGGAC CTCCATAACA CCGGACACTA GATGTCTAAG
127861  GGACACCTCT TAAGGAAGTT AGACTTCCAA AGAATGGTGT TTCCTCTGTC CCCAAACTCT
127921  GGAACTCACA GCACAACTGC TCCTTGGAGT TCGGTTTCAA ATCTACAAGG CTGTCATGGA
127981  GGTTGCAGAC CAAGTCCGTG GCCTCAGTGT CCGGATGTAC GGTGGCCTTG GCACCTGAAT
128041  GTGAGAACAT GACCTCCCTG AAACCACCAC AAGTATTGTT TCATGTTATG TATGTTTTTT
128101  CTTATCTGAA ATTCCTTTTC TTTAAAAATT CAAATTACAT ATTTTCAAG CCCCTGAACA
128161  AGCTTCATGA GCATTTATTG AACCCACAGC TTTTAAAACC TACTGAACAC TTTGCTCTAT
128221  GTTGTCATTC ACTATCCACC AATTATTTAA TTATTGATCA ATATTGTTTC CTTAGTGTTG
128281  GGATCATTTA TGCATGTATT TCTTTTATAT TGCATATTTT ATATTTCTGC ATTACAGTTA
128341  TTACATATTA CTTTTGCTAC AGTAATAGTT CAGAAGTGTA CATCCAAAAT TTAGCTGTGA
128401  AGTGGATGGA CTGAGGCAGA ACTGGAGGCA AGAAAATGTC ACAGTAATTC TAAAAAAGAT
128461  GATGTACAAT TAGAGCAAGA GAGTAGCACT GAAATTGAAG AAAAATAGAT GCGTTTGAGA
128521  GAAAATTAGG AGGTAGAATC AACAGATTAG ATGTAGGGAT GAGAAGGGTC AAAGATGACA
128581  CTAGGGTTTT TAACTGGAGC AAGTAGGTAG ACAGAACATT TCTTCCTGAA AGGGCAGGTC
128641  AGATCATGTG TTGTCTCAAA GGGCATGAAG AGTAGAAAGC CTGGGACAGA TCCTGAGATG
128701  ACCAATACCC ATGGTGCAGG GAGAGGGAGG GAGATCTGCT AAAAAGACTG CAAATGTCAG
128761  GATAGTAGAA AATCATGAGT GTGTGATGTC CTGGAAGTTG AGACAGTATC ACATTTGAGA
128821  ACATTTAAAT TGGTAACTCT GACAAAACCT GGAGGCCAAC TGTGAATGCC CATGAGAGTG
128881  AGAAGCTCCC ACACTTTTGT GGGCATCAGA AAGCCCACCA GGTTCCTGCA GTGAAGATCT
128941  GAGAAGGATC CTCTTGTGGC TTTGGCAGGG AGAAGAAGAAT TATTATGAAA TACACCCCAG
129001  AACCTTCTTC AAAACAAAGG CCTACTCTCA AGGGGAAAAC ATTTTGCCAG AGTCTTATCC
129061  CAGCTGGGAG AAGGTAATTC TTCCCACTGC AGCCTCATCT AGGCTTTCTG TCTCACTTAA
129121  GGAACAAAA TTAGTCAACA GGGATCAGAG CTTCATGAAA ATAAATTGGA AATGGTGCAG
129181  CCAGGAAAGG AGCAAAGGTC TGAGGAGGAG GAGAAGGAGG AAGAGGAGTT GTATCATTAT
129241  AAATACTTGA GGAAGAGGAG GAGAAGGAGG AGGAGGAGGA GTTGTATCAT TATAAACACT
129301  TGAGGAAGAG GAGGAGGAGA AGGAGGAGGA GGAGTTGTAT CATTATAAAC ACTTGAGGAA
129361  GAGGAGGAGG AGAAGGAGGA GGAGGAGGAG TTGTATCATT ATAAACACTT GTGACGGTCC
129421  CAGCCCCAAG ATATAGGCAT GCTAATAAAC TGAGGCTTAA CACTTTGACT ACAGAATGCT
```

```
129481  GCTTCTCCCT AACACCATCA AGGCTCCAAC TGAATAACAA TGAATTATGA ATGAAAGAGC
129541  TGTAAGGAGA GACAAAAGTT AGAATGAGAC AAGTATTGTT ATCTAGAGAT GCCAAGAAGG
129601  CAAGGAAGAT AACTAAAAAG GCACTCTGGA TTTAGAAATA GGAAGTCATT AGTGACCTTG
129661  TAAATAATGG AGCCAGAGGA ATACCAAGGG CAGAAGCCTC ACTATAGTGT GTTGCACCTG
129721  TCAGAGGTCA GGAGGTGTAA CTGACTCTCC CACAGTGTGG CTTTGGAAGA GAGAAGTCAG
129781  CAGCTGCATG GAGATTTGGG AGAGGGAAAG CTTTTTTTTT TTTTTTTTAA TTGGAAAAGA
129841  CTGAGCTATG TGTAAATAGA ATAAGACAGG AAGAGTGTAG ACACAGGAAA GAGGGCAGAC
129901  AAAAACAAGT GCACAGTTAT CTAAGGGAAA CAATGGGATC AAGCTGCAAG TATATAAACT
129961  TGTCTTGATA GAAGAATCCT TGATCTGGTT TATTCAGTGT TTGGTCCAAA CCCACATCCC
130021  TGTTCTGCCT GTCTCTGACT TGCTCTGTGC CCCAGAAGCC CAGCTTCTAC AGATAGCATT
130081  AGCTGGGCAG CCCTGCCCTC TTGCAACAGC TGGATTTGGC CAGTGATCAG CCCAGCAGGA
130141  ATGTAGATGG CAAAGGAGAG AGAGGTTAGT GTACTTATTC CCTGCATCAC CCCCCTGCTT
130201  GGTGGGCAGC TCTTCCTCCA CAGTCCCAGC TCTGGCCTAG CTCTGGTTAC AGGTTCCCTC
130261  CCATTGCCTC TTCAGATTTA AAGGTGTGTC TGTCAGGGTA TAACTGGGAG CTAGAAATTG
130321  CACTGAAATT GAACAAAGAA TTTTATGGGA ATGGTTGTTA ACTAGTTATA AGAGGACTGA
130381  AAATGGAAAA GTGGAACAAA CGTATCAGAG ATAGTAATGA CAGAAAGCAA CTACCACCTC
130441  CAGGTTTAGG AGAACAAGGA AAAGATTCTT TGAAGAGATC CCCAGAACTG GGACCTCTGA
130501  GGAGTGTATG CTGGACCACT GATGATGATA TGTCTGTAGA TAGAGGCATG ATGAGGCTGA
130561  TTTTAGGAGC ATGGAAGATC TCCAAACTGA AGCCAACTGC TGTTACTGGA TTCAACTGCC
130621  ACTGCCAGGT TGAAGAACCC ATTCTGTGAG GATGTCAACA AACAAAGTGG GAAATCTTTT
130681  CACATCCTTC CAGCCCTCTA GTCTTCCTCC AGTGCTTTCT ATTGGTAGGG TTTGGGGAGG
130741  TGGCTAGCAA AGCGGTATTG GAAAAGATAG AAGAGACTAA ATCTTCATAA CCAGCACAGG
130801  GTGACACTGG ATCACTACTG TTGCTGATCT TGGGCTGCCT CATATCCCCT GTTCTTCCCA
130861  TTAGCCCTGT CACAACTTTG TAGATATCCC TTCATTATAT GCCCTTCATA TATTCTTTTG
130921  GTTAACTTT TTCTGTTGGA ATCCTAATAT GGCACTCCTC CATTTTTCAG GACCAAAAGA
130981  GTATAAAAGA TTATCTTTTA CCAAAAAAAA GACAAAAAAC TGATCTAATT CCTGATTTGA
131041  TCATTACACA ATCTATACAT GTATCAAAAT ATCACATAGT ACCCCATAAA TATATACAAC
131101  TGTGTCCATT AAAAATAAAA ATTAAAGAAA AGATGGTAAA TATAGCTCTG TCAGGCAGTG
131161  GAGGTTTTAC CACGATGGCT GTTATTTCCC CCATGAAGGG GGGAGTGAGG GAGCAGCTGA
131221  AAGTAGGTGC TTATAGGGGT ATAGAGGGGC TCAAAGCTTT GAGAGAGGAG AATGTCTGAA
131281  AGAGCTGCCA AATAGCATGC AGGTCCCATG GGGGCAGAGC CTCTGCTCAT TCACCAGTGC
131341  CTCTTCAATA TCTACACTTA AGCCAACAC AAAGTGTGTG CTTAATAAGT ATTTGCTGAG
131401  TATGTAAAGT GGAAACAGAA CCAATCTGGC AAACTTTGTA GGACTGGTGG GCAATGAAGA
131461  TCAGTCAGGT AAAATCTGTG GATATAAATT TATATTGATC AAAAAATTCA AGGTTAGGTG
131521  TTTTTCTTCA GTCATGCTCA ACGATGCTTC AGCCATGCTC AACTCTTCTG TAGCCACAGA
131581  AAAAAGTTTA CCCATAATCG AGCTGTGTCT GTGTCTGAAT AATGAAAAGA CCATGATGCA
131641  AGGGAGTTGG AGACACAGAA ACAGTGTTTG AAGTAATGGG TAATGAAGC ATGCTACCAG
131701  GGAAAGGAAA GAAGTGGCAA TAGGAAGGAA CAGAGATCTG TGGTCCTATG TCCCCTGAGC
131761  ATATTCACAT GTTAAAGCTA ATTCAGTTTT CAATCATCAT TAAAATTTTG TTCCTAAATA
131821  TATGGCCATT ATTTTCCACA ACCACACTAA AACTTTATTA CCTCTGGCAA GTGACTATGC
131881  AAGTAACTAA GAGCAAAAAT ATCCACAACT ACCATTTGAG CTATCAATTT AGGGAAAGTC
131941  ATCTGGCTAT AATCTAAGTG ACCCTCCACT GAATGTCAGT ATCTTTGCAT ATGTGATTTA
132001  AATCTGGGCC TTCGCAACAC CATGAACTGT TCTTGTCTTG AATATCCAGA TTGAAGGAAA
132061  TAATCTGAGT AGTTACGAGT CCTGAAGCTA GAAAGATGGA ACCCCATTT GCTCATCAGA
132121  AAGCCTTAGA GCTTGGGCGC TGGCGGGTCC TGTCTCACCG GGACAGAGGG GCTCTTTCCT
132181  CCCCATCTGA TAGTCTGATA ACTAGAGAAG CCGGCCAACT TATTCTCCAA GAAGGAGCCA
132241  TCTTAGTTCC TCCTGAAATG TTCATATTTA GAAATTATTG TTTGTCAGTA ATTTAACCCC
132301  TTAATGGGCT TGCCTTGTGG TCCATACCAC TGAGTGCAGA GCTTGCCTGG AAGAATTGTG
132361  AGGGCCATTC CATCTTCCAG GCAGTAGAGT TCAGTACTTC TTTAAAATTG CTGCTGAACT
132421  CTGTATTTGA AAAGAAAGAA TCATTTGGGT GTGGTAGCTC ACACCTGTAA TCCTAGCGCT
132481  TTGGGAGGCT GAGGTGGGAG GATCATTTGA TGCCAGGAGG ACCACTTGAG ACCACCCTGG
132541  GTAACATAGC AAGACCCTGT CTTTAGAAAA AAAAAATACA ATAAAATAAA TACAATAAAA
132601  ATAAAAGCAA AAAGAAAGAG TCCATCTTAG GGACAGACTG TAACTACTCA CTGGAGCTTA
132661  CCTTTACATA GTTCAGGATC AATTATAATA AAACACTTTT GTGCAGATTC AATAGGATTA
```

Figure 2 (Page 41 of 74)

```
132721 TTTTAATCCC CATCATCTCT CTGAGTTTCC AGTCAGTTTC TCTGCATGTA GACACCCTTC
132781 TCCAGCCCAC CATTGTCTCT CCTCCTATAG CTCCACCAAC AAATCAGAAC TTTTTCTAAC
132841 TGCACCTAGT GCACCTAGAG TCTACTCCAG AATGCTCATG GAGAAAGTTT CTGAAAGGTA
132901 AAACTCTGAA TGATATTTGT AGCTAAAGGG AGACTTGCTA GAGACAATAA GCTAATAGTT
132961 GTAGACTTCA GTAGAAGAGG AATGACACTG CAATGTCAGG GTGCAGGACT TCAAGAGGGC
133021 AGAGTATGGA AACCCAATGG GAAAAATGCT CACCAGGAAC ATGAAGAGAA GGAATTACGT
133081 GTAAGGATTT CTCAATGTGT TCCCAAATTT GCCCAGCAGA GGGAGGCCTC GGGTTGATGG
133141 CAGGCTGACC ACACAATTAA AGAAGGCTGA ACCTGGGGC TTTTAACAAC CATCGTGGGC
133201 TCTACTGTAA GCATTTAGAA AAAGAAAGTT ATCCATTCAA AAATATATAT ATTTTTAAAC
133261 TTCAGAACAA AATTATGAAG AGCTATATTT ACTTTTCTAC ATTCTAATTT TTATAAATCT
133321 GAGTATATTT TGCATATATT GTTATAGTAC ATATTCAATT TTGTATTTTG CTGTTTTCAC
133381 TTAACCATTT TTACTAGATT ACTCTGTGTT CATAATAATC ACTTTTTTAA AACTTTTATT
133441 TTTATTTATT TATTTTTTTT TTGAGTCAGA GTCACACTCT GTCGCCCAGG CTGGAGTGCA
133501 GTGGCGTGAT CTTGGCTTAC TGCAACTTCC ACCTCCTGGA TTCAAGCAGT TCTCCTGCCT
133561 TAGCCTCCTG AGCAGCTGGG ATTACAGGTG TGCACCACCA AGCCCGGCTA ATTTTTGTAT
133621 TTTTAGTAAA GACGGGGTTT CACCATGTTG GTCAGGCTGG TCTCCAACTC CTGACCTCAT
133681 GATCTGCCCA CCTTGGCCTC CCAAAGTGCT GGGATAATCA CTTTTTATGC TGCATAATTC
133741 TTCAGATTTG TCAGTACGAC TGTATTTACA CTCATTGTT TTATTAGAAA GAATTCCAGA
133801 ATATTTTGGC TGCCCTAATT AATTTTACAA TTAATATGAT TTTGAAATTG GGTATTGGCT
133861 CCTTCTGAAT TGGTTTATTA AAATATATTC TAATGTAATT TATGACATTT TCATCATATT
133921 AGCATATTTA TTCTGTTAGA ATTTCATAAT TTATAAAGCT ACAAACTGTA TGTGATATAG
133981 CTTGTAACTT TATCTCATAA CTTTATGCAG TTACAAGTAG AAATAAAATG TTCCCCTCAA
134041 GATTGCTTAA AATTTTATTA TAAACAAGTG TAAAAAACAA AATCACTAAA ACACTCCCTC
134101 TTTTTTCCCC CAAAATGCAT GTTTCCATTT TAACAGAACC CGTATTTAAT CAGCAGATTT
134161 CTATGGTGGC TAGATTTGTA GACTAAATAT TAAAAGTCCC AAAGCAAATG CATTTTTCTC
134221 TTAAATTTTA CTGACTTTTT TTTTTTTTCT TTTTCTGAGA CGGAGTCTTG CTCTGTCGCC
134281 CAGGCTGGAA TGCAGTGGCA CAATCTCGGC TCACTGCAAC CTCCGCCTCC CGGATTCACG
134341 CCATTCTCCT GCCTCAACCT CCCGAGTAGC TGGGACCACA GGCGCCCGCC ACCACGCCCA
134401 GCTAATTTTT TGTATTTTTA GTAGAGACAG GGTTTCACCG TGTTAGCCGG GATGGTCTCG
134461 ATCTCCTGAC CTCATGATCT GCCCACCTCA GCCTCCCAAA GTGCTAGGAT CACAGGCATG
134521 AGCCACCGCG CCCCGCCTAC TGACTTTTAT CCAAAGAAAA TATAAGAGCT CTTCATCATA
134581 ACGTATGTTT CTTGCTCTTG TTATTAAATA TGACACATTT AGACTTAAAC TGATTTGAAG
134641 GTTTATGACA TTGTTTAAGT TATTACATAA TTAATTCATA AAGATAATGA CTAGTTTGAA
134701 CTACTGACAG CTCACACATC ATCAGTTGAA CAGCAGAAAG CTTATTAAGC TACTTTCTTA
134761 TGTTTCTGTC TCCCAGCTAC TAAAAGAAAC GAAACCCTTC CAGGTGTTAA GGCAAAACTT
134821 TCCTCCCCCT TTCTTCTATA AATCTGATTC CATGTTAGTG AAATTTCTAC TGATGGCTTT
134881 GGTTTCCTCT ATAGTAGAAT AGAGATCCTA TGGCAAAAGT CATGTCTGAC ATGGTAGCAA
134941 ATAGAAATGG GGAAAAGGAA GGTCTGCAAG AGCCAATGTG GAAATGGGG AGAGGACTGA
135001 CTACAAAAAC CCAGCAGGAA TTCCAGAAGA AAACTCCTCA GGACGGGCAC ATTGGCTCAT
135061 GCCTGTAATC CCAGTACTTT GGGAGGCCGA GGTGGGCAGA TCACTTGAGT CCAGGAGTTT
135121 GAGACCAGCC TGGTCAACAT GGCGAAACCT CATCTCTACA AAAAATAAAA AAATTTGTCA
135181 GGCGTGGTGG CATGCACCTG TAGTCCCAGC TACTCAAGAG ACTTAAGTGG GAGAATCACT
135241 CGAGCCTTGG AGGTGGAGGT TGGTGAGCCG AGATCACGCC ACTGCATTCC AGCCTGGGCG
135301 ACAAAGTGAG ACGCCATCTC AATCAATCAG TCTCCTCGAA AAGCAACATT ATGGAGAGAC
135361 AGGATTCCGT CAAGGCCTGG GGCACACAGG AAAATATTAA GGCAGAAGAG AGTTTCCTCC
135421 CCACACCACA CCGTATCCCA CAGGCACTGC GGATGTGCAT ATGCAAGAGG GGTTGATCCT
135481 AAGAATTTAG AGTCACAGAG GAGGAGGCAC CAAGCAGACT GTGGAGAAAG TCATGACCAG
135541 AAAGGGACAG AATGTAAAGC TTCAGCTGAT TATCTGGCCT CAGGGATTCC AGAGGAACTG
135601 GTCCCAATGG TCTCCTGGTG ATGTACGTTC TTAGGTTTCT TTTACAGGGG TTTTCTGGGA
135661 GATCGTTGAC CCAGTTAGCA TTCAAGCAAC TTCCACCCTG CACTTTTATT CTTTCCCCTT
135721 CACCTGCTTA GGTTTTATCT GTCCAGGCAA TAATAATAAA ATTATTGAGC CCTGGACATG
135781 TACCTGTAAA GCTCCTTAAA GATGATGCCT TCTAACTCCT CATTCAACAG ATACAAAAAC
135841 ATTACAATAA AATGACTCAT GCAAGACACC CAGGTAGTTT ATAGCAGCTA ATAAAAACAG
135901 AATAACTATA AAATATGGTA AGTTTATAAA AGTTACATTG AGTATACTTT ATAAGAACTG
```

Figure 2 (Page 42 of 74)

```
135961  CTTATTGAGT TTGCCTAATA ACCACACAGC ACAATAATAA TATGTATATA TTTTTAAATA
136021  TGTGTAAATA TGTGTAACAC AAACTTGTAG AAGGTATATC TGAGTACAAC CCTATTCTGT
136081  TTGGTTACCT TTTCTAGTTC ATTATGTAAG TGGCATAGCT ACCTAAGGAC TTATGCTTAT
136141  AAATGTTACT CAAAAAAATA CAGAGGACAT ATGTGGATAG ATAATGGAAG AGATAAGATA
136201  GGTAGGTTGA AGGGTTGGGC TGCCCCTCCA CACCTGTGGG TGTTTCTCGT TAGGTGGAAT
136261  GAGAGACTTG GAAAAGAAAG AGACACAGAG ACAAAGTATA GAGAAAGAAA AAAAGGGGTC
136321  CAGGGGACCG GTGTTCAGCA TACGGAGGAT CCCACCGGCC TCTGAGTTCC CTTAGTATTT
136381  ATTGATCATT ATTGGGTGTT TCTCGGAGAG GGGGATGTGG CAGGGTCAAA GGATAATAGT
136441  GGAGAGAAGG TCAGCAGGTA AACACGTGAA CAAAGGTCTC TGCATCATAA ACAAGGTAAA
136501  GAATTAAGTG CTGTGCTTTA GATATGCATA CACATAAACA TCTCAATGAC TTGAAGAGCA
136561  GTATTGCTGC CAGCATGTCC CACCTCCAGC CCTAAGGCAG TTTTCCCCTA TCTCAGTAGA
136621  TGGAATATAC AATCGGGTTT TACACTGAGA CATTCCATTG CCCAGGGACG AGCAGGAGAC
136681  AGATGCCTTC CTCTTGTCTC AACTGCAAAG AGGCGTTCCT TCCTCTTTTA CTAATCCTCC
136741  TCAGCACAGA CCCTTTACGG GTGTCGGGCT GGGGACGGT CAGGTCTTTC CCTTCCCACG
136801  AGGCCACATT TCAGACTATC ACATGGGGAG AAACCTTGGA CAATACCTGG CTTTCCTAGG
136861  CAGAGGTCCC TGTGGCCTTC CTCAGTGTTT TGTGTCCCTG AGTACTTGAG ATTAGGGAGT
136921  GGAGATGACT CTTAACGAGC ATGCTGCCTT CAAGCATTTC TTTAACAAAG CACATCTTGC
136981  ACAGCCCTTA ATCCATTTAA CCCTGAGTTG ACACAGCATA TGTCTCAGGG AGCACAGGGT
137041  TGGGGCTAGG GTTAGATTAA CAGCATCTCA AGGCAGAAGA ATTTTTCTTA GTACAGAACA
137101  AAATGGAGTC TCCTATGTCT ACTTCTTTCT ACACAGACAC AGTAACAATG TGATCTCTCT
137161  CTCTTTTCCC CACAGGAGGT GATGGCCGGA AGAACATGGC AGAGGGCAAA ACAAAACAGC
137221  ATTGGGAACA AGCTCTGTTT AAAAGGAGAC TTGTGAACAG CAAAGAGTAG AAAGGGTTCT
137281  CTTACAACTG AAGCCCATGG AAGACAAATG TGTACTGCGT GAGTTTTAAG GCAATAGGAG
137341  TAGTGGGACC TAGGGCACAC CAGAGAGCAT ATTAACTCTC AAACTTTTAA AAACATTATA
137401  TCTGCTGGAC ACAGTGGCTC ACACCTTAAT CCTACAACTT TGGGAGGCCG AGGCGGGCGG
137461  GTGTAGCTTG AGCCCAGGAG TTCGAGACCA ACCTGGGCAA CATGGCAAAA TCCCGTCCCT
137521  ACAAAACAAA CAAACAAAAA ACAAAATTAG CCAGGCACGG TGATGCGTAC CTGTGGTCCC
137581  AGCTACTCAG AGGCTGAGGT GGGAGGATCG CTTGAGCCCC GGGAGGTTAA GGCTGCAGTG
137641  AGCCATGATA ATGCCACTGC ATCTCAGCCT GGGCAACAGA GGGAGAACCT GTCTCAAAAC
137701  AAAAACAAAA ACACACCATA CCCAACCACA ATGCATCTGT CTTAAGTACC AGTACCACAC
137761  CCCTCTACTC ACTACTAAAT AGGTGAGTTC CCAATCCCTG GTAGCAGGTT TAAGCATGTT
137821  ATATTAAAGG TCTTAGGCTA GTGACTCATT CACTCATTAA ACAAATACTT ATTGTGCATC
137881  TACTATAAAC TAAGTACTGT GCTAGGTACA AAAGCAAATA ATCTAAGCTC TATAAACTTT
137941  ACTTTCTTCA TCAACAAAAT GGAGATGTTT TAGGCATCTA CTCATCATTC TGAGCTCCAT
138001  CTTTTGTGAC TGTAGTTGGC AGAGCTTTTT ATCAGTTTCT CTAAATAGCT CTACCAGTCC
138061  CTGGTGGATG CTGGCATGCC CAAAGGATCC ATCCTGATGG CCCTGTCTGC TTACCTTACC
138121  TGCCTGCCTT TGCAGCACCG CTCTGCTCTT CTGCAGGACT TCCCTTATCC TTTGGGGTCT
138181  TGCTGCTCTT AGGCTGCTCT GCTTGTTTTG ATCTGCTTTG CATCACATGT ATGTAAAGGT
138241  CCTTTCCTTA TTTACCCATG ACCAAGGTAT TATGAGATTC TGGAATTTCC CCAAACCACA
138301  TTGATTGCTG GGAGAATAGA AGAAGTGGAT TACAAGTGGA ACTTAGAAGG GGAGTATTCG
138361  AGAAGACGTC TCTGCAAATC CATTTAGAGA GACCTTTCTC CAGTGGTGAC TCAAAGATGC
138421  AGCTCCTTTC ATCCTGTGGC TTGGCCATCT TCAGCACATG GCTCCCAAGG ATGTCCTCAG
138481  GATGGTCTCT AATCCAAGGA GCCTGAAGAG AAAAAAAGGC ATGGAGTATT GTGAGTGGTA
138541  GGTGGTTATG GACCAGTTAT GGAAGAATAC ACATCACTTT TGCCCACCTT CTACTAACCA
138601  GAACTCACAC AGCCATAGAC ACTGACAAGT AGGACTTAAC AAGAATCTAA TTTTGAGTCT
138661  AGGAATACGA CTGTAGCAAA TATTTAACAG CTTCAAACAC AGGTGCATTG CTATCACTAT
138721  GCTTGGCCCA GGCCTGTCTC CCTTTCCTGC CATGTCACAG GGCCAGCAT TTATGTCTAG
138781  ATTGGGTTGG TTGGGATATT AAGACAATAA TGAACCAATA CAACATCTTG AGCATAAAAC
138841  CAACTGATAC AATGATGTAC AAGTCAGATG ATTCTGATGA TTATGAATTA TGTCAATAAA
138901  AGAAATGTGA TAACTAAGGT AATTTTTGTT TTGCAAATT TTTGTTTGTT CATGACAGGA
138961  TGAAATCCTG TCATTTGTAG CAACATGGAT GGAATTGCAG GATACTACAT TAAGTGAAAT
139021  AAGCCAGAAA CAGAAAGTTA AACACCACAT GTTCTCACTT ATATGCAGAA GCTAGCTAAC
139081  TAAGTAAATA AGTTTATCTC ATTGAAGTAA AAGTACAAC AGAGATTACT AGAGGCTGGG
139141  AATGGTAGGG GAAAGAGATG ATAAAGAGAG ATTCATTAAA ATAAGTTACA GCTAGATAAG
```

Figure 2 (Page 43 of 74)

```
139201 AGCAATCAGT TCTAGTGTTC TATTTGTACT ACAGAATGGC AATAGTTAAC AGTAATAAAT
139261 AATTTCAAAG AGCTAGAAAA GAGGACATTG AATGTTTCCA ACACAAAGAA ATGAGAAATG
139321 CTTGAAATAA TGGATATTCT AATTAATTAC CCTGATCTGA TCACTATACA CAGTATGTAT
139381 AAAAATAACA CTATGGGCTG GGCGCAGTGG CTCACACCTG TAATCCCAGC ACTTTGGGAG
139441 GCCAAGGTAA GCAGATCACT TGAGGTCAGG AGTTAGAGAC CAGTCTGGCC AACATAGTGA
139501 AACTCCATCC CTACTAAAAA TACAAAAATC AGCCAGGCGT GGTGGCATGT GCCTGTAATC
139561 CCAGCTACTC AGGAGGCTGA GGCAAGAGAA TTGCTTGAAC CCAGGAGGCG GAGGTTGCAG
139621 TGAGCCGAAA TCGCGCCACT GCACTCCAGC CTGGGTAACA GAGCAAGGCT CTGTTTCAAA
139681 AATAAATAAA TACATAAATA AATATTTTTT AAAAAAAGAA CATCACTATG CACCCCATAT
139741 ATACATATAA TTATTATGTC AATTTGAAAC ATAATTTTGA AAAATGAAAA AATGAAACAC
139801 AAATATGAAT CAATCCTCTC CAAGTTGATA TACTTAAAAG GAAAAAAGTC CGAGGGCTTA
139861 AACTATTCAA TCAAAATTTT ATTAAAATGC TATAGTAATC TGGAAAGTAT TTCAGAATGA
139921 ATTGGTATAA GGTTAGACAC AAAGATCAGT GAAACAAAAT AGAGAACCCA GAAATAGATT
139981 CACACATCTA TGGACAACTG GTTTTGACAA AGGTGTCAAG GCTATTTAAT AAGTAAAAAA
140041 ATCGTCTTTT CAGTAAATGT TTCTTGAACA AGTAGACATC CGGTGTGGGG GAGAGGAGCA
140101 GGAGCCTTAC CTCAAACTTT ATGCAAAAAT TAACTCAAAA TAGACCATAG ACTTAAATGT
140161 AAAAGCTAAA ATTATAAAAC TTCTTTAAAA AATAGGAGAA AATCATCAAC ACCCTAGGAT
140221 TAGCAAAGAT TTCTTTAAAA CAAAACAACA GGTTTATAGT TTATAAAACA TAAATAACAA
140281 AATGATAAAT TTCATCAAAA GTGAAAATTT GCTTTTCAAA AAACATTATA AAATGAAAAG
140341 CAGGAGGCTG AGGCATGAGA ATCACTGGAA CCCGGGAGCT ACAGGTTGCA GTGAGCCAAG
140401 ATGGTGCCAC TGCACTCCAG CCTGGGTGAC AAAGTGAGAC TCTTCCTAAA AAATAAATAA
140461 ATAAATAAAT AAATAGAAAA GAAAAAGAAA AATCACAGGC TGAGAGAAAA TATTTATAAT
140521 ACATGTATCT GACAAAGGAC TCGCACCTGG AAAATATAAG GAACCTTATA ACTTAGTAAG
140581 ATGACAAGCC AAAACAAAGA GTAAAAGTTT TCAACAGACA TTTCACAAAA GAAAACATAC
140641 AAATGGCCAG TATGCACATG AAAAGATTTT AAACATCATT AGTTACTAGG GAAATGCAAG
140701 TCAAAACCAC AATGAGATAC TTCACATTCA ACAGAATAGC TAATGTTAAA AGGACTGACA
140761 ATCCCCAGGG TGAGCAAGGG TGTGGAGGAA ACTACTCTCA TATATTGTGA ATGTAAGAGG
140821 ACAATGTTAC AACTACTTTG AAAAAAGTTT GGCTGTTTCT AACATAAAAT TAAACACTTA
140881 TACAGCCCAG CAATATTTCT GGGTCATTTC TCCCAGATAA ATGAACACAT GTCCATACTA
140941 TGACATGTAC AAATGTTCAT ACTGGCTTTG TTTCACAATG CTATAAACTG GAAACAACCC
141001 ACGTGTCCAT CAACAGGTGA ATGGGTAAAT AAATTGTAAT ATATCGGCCA GACGCAGTGG
141061 TTCATGCCTG TAATCCCAAA ACTTTGGGAG GCCAAGATGT ACGGATCACC TGAGATCAGG
141121 AGTTTGAGAC CAGCCCATCC AACATGGTGA AACCCCATCT CTACTAAAAA ATTAGCTGGG
141181 CATGGTCACG GGCGCCTGTA ATCCCAGCTA CTCGGAAGGC TGAGGCAAGA GAATCACTTG
141241 AACCGAAGAG GCGGAGGTTG CAGTGAGCCA AGACCATGCC ATTGCACTTC AGCCTGGGCA
141301 ACAAGATGGA AACTCCATCT CAAAAAAAAA AAAAAATTGC AATATATCTA TATCTTGGAA
141361 TATTATAAAG CAATAAAAGG GAATAAACTA CTGATATATA CACAAAATGG ATGAATCTCA
141421 AAAATGTGAA GGAAAATAAA AAATACATAT GATATAAATT CCATTCATAT GAAATTTTAG
141481 GAATGGGAAA ACTAAGCTGT AATTATGGAA AGTACATCAG TGGCTGCCTG GGGCCAAGAG
141541 GATGGAAGAG GCGGCACAGG TGATACTACA AATGGAAACT ATCTAGGTTG ACGGAAGTGT
141601 TCTGTAACTT GATTACAGTA GTAACTGTTT GGGTATATAA AACGCATCAA ATTGTATAAT
141661 TAATACAGGT GTATTTACT GTGTATAAAT TATTCCTCAA TAAAGTTGAT TTTTCATTAA
141721 ATATATTATT TGCTAAAATG AGGAGAGACA ACTATTATCT TAAAATAGTT AAGCACAATA
141781 AAAATACTAC AATCAACTCA TTATATATGG AAATTAAAGG AGAAAAATAG TGGTATGATT
141841 AATTAAAATA AAAAGAAAAC CTTCTAAATT TTATCTTAGC TCATAGTTGT AAAAGCTGCC
141901 ATCCCTAACC AAGGCCACCC TTGACCCTTT CTCATGTTCC ATCTTTCTGT TTGTTTCATA
141961 GTTTATGTCT CACCAAAATC TATCAGATAA ACGTATTCAT ATGAAGATTT AAATATATTA
142021 CATGTTAAGC CTTAGCGAAT ACTTCAATAT CTAAAGAAGG TACAAACAAA ACAAAAATCA
142081 ACACTTAGTT ATAAGAGATT ACATACTCTC CAGGGAAGAC CTGAAGACTA GCCCCTTTCT
142141 GGATCCCACT AGCCCCTCAT CCCACTCCAA GCCCTCCCCT CAATCCCAT ATGCACTGGG
142201 CATTCATACA AATAAGACCA TCAGCTCTGG ATATCTGTAC TGATTGATGC TCCTGCTAAC
142261 TACCTGAATG ATTGCGATGT AAGGACAGCA CTGCCTGAAT CCTATTTATC TCTCGCTATG
142321 CCATAGCGGC CTTCCATGCT GATGGCGTGT TTGAGGATCC AGAGGGTCT TTGGTTGGCA
142381 GGATTGTTTT ATTTCCCCAA GAGGAGAGCC TTGATGCAAA AATAGGTGAA GAAATCAGTA
```

Figure 2 (Page 44 of 74)

```
142441 CAACAAAACA GAAAGCCTAG AAACTACTAT GAACACAATA GAGCAGAAGT AGCCTTAAGA
142501 GTTGGTGGAG AAAGGATGGT CTATTCAATT ACCTGAGCTG AGAAACTGGC TTTCATATGG
142561 AATAAAAATA AAATTATAGC TATACCCCAT ATCATACACA AAAGTTTCTA CATCTAACAA
142621 AGACACAGAT AGAAAATGTT TTAAAATTTT AGAAGAAAAT AGTGCAGAAT TTTAGTGCAG
142681 AATTTCTTAG ACTAGATGCA AAAACAAAAA TGATTAAAGT GGCCAGGCAC TTTAGTGCAG
142741 GCCTGTAATC TCAGCACTCT GGGAGGCCGA GGTAGGTGGA TTAGTGGAGG TCATGATTTC
142801 GAGACCAGCC TGGACAACAT AGTGAAACCC CATCTCTACT AAAATACAAA AATTGGTAGG
142861 GTGTGGTGGC TCACGCTTTT AATCCCAGCT ACTTGGGAGT CTGAGGCAGG AGAATCACTT
142921 GAACCTGGGA GGCAGAGGTT GCAGTGAGGG GAGATGGCGC CACTGCACTC CAGCCTGAGC
142981 AACACAGCGA GACTCTGTCT CAAAAAAATC TAAAAATAAA AAGATTATTT TTAAAAGACT
143041 ATTTTAAACA AAAAAAATCG TTTAAATGAT ATGATACACT ACATCTAATA TTTGGAAAAG
143101 TACTTCTTAA TACTTTTAAT AAAAAGAGGC GCTGAGAGCA TACAACCTAT CCTCAGAAGA
143161 GTGTTTGACC TCTAGGAGGG ACGCAAGCGC GTTCTTCCTT CATTTTAACT GGTCATTTTC
143221 ATTTATTTCA GGAACATCTG AAGTAAACAC AGTCACACGT TAACCTTTAA AAATCTAGGA
143281 GGTGCGTACG CATAGTTCCA TTACTTCAAT TTTTGTACTT TTGCATTTTA AAATATCACA
143341 GGGAAGCTCG GTACAGCTTC AAGGCTAGGA GGGGTGGCTC TCTCTTAAGC CCTGTCCCCG
143401 CCAGCCCCAG ACCTCTCGTC CCGCCCCCAT TGCCCAGTCC CCACCCTCAC TTCCCCATTT
143461 CCCCACTCCC GCGGTCTCTT AACGCACCTG TTTTTCGTCC AGTGGACTCA GACCTGTACT
143521 CTTCCACCAG GATCGGCTCC TTTCCCGGAG CTCTCGCTCT TAGAGGAAAT TGAGAGAAGC
143581 ATCAGCGGAG ACCCATCTGT GGCTCTCCAG AGGGCGCGGC ATTCAGACCC CAGATCCAGC
143641 TGTGAGAACG GACCCCAGGC TCACACCAGG CCTGCGGGAG GCGGCCCACC AGAGGCGCTA
143701 GAAAACAAGC CTCGCGGGGA GGCGCGCAGG GCGACTGCAA GCTGTAGGGG GCGCTGGCGC
143761 CCTCACAGGC CAGGGGCAGG GCCGGCGCTG CGGGCGGGGC TCCTGCGGCG TGAGGGGCGG
143821 CCCCAGGCCA GCAGCTGCGC CCTGGCTGGG AGCCGGGGAG CATTTGCTGC TCTGCTGGAC
143881 CCTGAGTCTG GCGGCGGGCG GCCTCCTCTC CGCTCCCCGC CCGCCATCCC CCAACTCCCG
143941 ATCTCTCTGC TGCGTCTGGC CTCAGGCTGA GACCCCAACG AATCATTCCC CGCATGGGAA
144001 CATTTTATGA TATAACTGAA TTCAGTTTTA TGTATAACTG AATTACGGAT ATGAGAATCT
144061 CAAATGAGGA CGAATGGTTT TTACGCACAA AACATGAGAC ACAAATCTGT AAGAAATATA
144121 AAGTCGTGAC CACGTCCTTT CAGAACTTTA ACCTGTTTGC TGAAGTACGT CAGTAACAAT
144181 GGCAGGGAAA GGGTATCTTA AATTTCACCA CAGCCTCAAA GAGGCCATTT CGTGGATCCG
144241 CTGAGGCTTG GAGTCGGCCT TCTGACCACG AGTCCTGCGG CTATGAAAGA GGAAGCCGCG
144301 GTTCAGGGCG TCCTCGCGAG TCGCGCAGCC CGCCCTGCTC CAGCTGGGGA CACAGGTGGT
144361 CACGGCGCTT TCCAGCTGCA GATCCAGGCG GCAGCCCAAG ATTTGGTCCA GCCGCCAAGG
144421 GGTGGCTCGA GTGACTGACG GGCCTTGAAC GCTCCCAGGA CCCACATCTG GAGAGGGAGG
144481 TGGGGGTGGG GTGCTGAAGT CATTCTTGGG GCCCCTGGGG GCGGGCATGG ACCTGGGTAA
144541 GGCCAGAGAA ATTGACACCT CGTGACATCC CTGGAAGAGA AGTACGTTCA GTGTCACTCC
144601 AGAGCTGAAA GATACCGCCT TCTGGCTGGT CCCTCCTCAC CTACATACTT TTCTAATTTG
144661 TCTGGAGCAG GCCGGGCATC TGTATTATCT GGTTATTTAA ATATCTGGTT ATTTAAAAGC
144721 TCTCCATTAA ATTCACATAC ACGAAAATAA AAATTAAAAA AAATTTAAAA AAAAAGAAAC
144781 AAAAGCTCTC TAATGACCAA GTCCTACACG ATAGTGAATA AATTTTTTTG TGTGGTCCCT
144841 AAAATTGAGT TCATGCCTTT TCTGAAGTAA TAGACGCCCA GAGAAGGGAT CGACTTACCC
144901 ATCATGCCAC AGAGATTAAT TGGCCCAGA ATTCTTTAGC AGACCGTGTA TATGAACGTC
144961 CTTTGCAATC ATATAAATTA ACTGGGAAAA CCTCATTTAG TATGTTACAT GCCTAGCGTT
145021 TTGTGCCTGA ACACCTTACA AGAACCAGGG ACTATTGCCC CAATATTATA TTTCAGGAAA
145081 GGAAGGCCCA GACAAATGGT GTCACTGGTC CACTTTCACC CAGTTGGTAA ATGAAACCAG
145141 AAATTATAGC TGTACCACAG AAAGGTGAAA ACGTTTCTTT TATAATTTCA CATACAATCT
145201 TTAATGGACC CAGTGTCCAA CACATTAAAG CAAGTGCTCA GGAGTGACAT CAAGATGTAA
145261 AAAATAGTCC TGTCCTCAGG GAGTTTAGGT CTTGGAGAAA AGAGACCCAA GGAGACACAA
145321 GACAAGGGG AAAGAGAAGG AGCGCTGAAG ACTGAGGACC CTGCCTGTGG ACTGAAGTGA
145381 GGATGGGAC ACCCGATGCC CGGAATATGA CAGTTTGGAG GGGCCTGAAG GACTCTTCTA
145441 TTCTCTATCA GAAAACAGA ATTACTCTCC TAACCAGAAA AGGTATTTCA ATTTATATTT
145501 TCCATCACAG CACTTTTCTG GTGATAATTT AATGTGTTTT AAAAAATGTA TCACAGTGAT
145561 GGCCTGGTGT GAAATAAATA ATAAAATTTT AAGAATTAAA AAATATAAAA ATCTTTTATA
145621 TAGACATTAG GAGTTACAAG GATAACTGTG AATTATAATT AGTAATTAAA TTGAAATACT
```

Figure 2 (Page 45 of 74)

```
145681  GATTATTTTC  ATTTTTATTT  AATTATTTAA  TAAAACCTAT  TTAACATTTA  ATATTTATCA
145741  GTAATTAAAT  CTAATTGTTA  ATATTTATTA  TTATAAATTA  TTTTAGAATT  AAAAATAAGT
145801  GTAGAAGCGA  GGCATGGTGG  CTCAAGCCTG  TAATCCCAAC  ACTTTGGGAG  GCTAAGGTGG
145861  GAGGATTGCT  TGAGCCCAGT  AGTTCAAGAC  CAGCCTGGGC  AACATGGAGA  AACCCTGTCT
145921  CAATACAAAA  AAATGAGCCA  TGTGTGGTGG  TGCGTGCCTG  TATTCCCAGC  CATTCTGGAG
145981  GCTGAGGTGG  GAGGATGACT  TGAGCCTAGG  CAGTCAAGGC  TGCAGTGAGC  CCTGATCTTG
146041  CCACTGCACT  CCAGTCTGGG  CAACAGAGCA  AGACCCTGTG  TCAATATACA  TATGGACAAA
146101  CTTAAAATTT  AAAATGAAAG  CATACTACTG  ATACAGAATT  GAGTAGAGAT  GCAAAGCTAG
146161  TCCTATAACC  AGAACAATAA  AGATAAAAAG  GAGAGTGGAA  GAAGGTATGT  CATGAATTTC
146221  ATGATAAATG  GCAATTGCAA  ATATCCTGTA  GCAGAACAAA  ACAACAAAAT  TGTAGATAAA
146281  ACATATCCAA  CCCTTTGGAA  GGCCAAGGAG  GGAGGATTGT  TTGAGCCCAG  AAGTTGGAGA
146341  CCAGCCTGGG  CAACATAGTG  AGACCCTGTA  TCTAAAAAGG  AAGAAAGAAA  AAAAAAAAAA
146401  AGGATGATAA  AGTAGACAAT  ATTGAAAGCC  ATTTTCTGCA  AATACATAGT  GAATTTGATC
146461  AGTAATTTTC  TTCCAACAGT  GCAAAATGA   ATAGATATTA  GTTGCCTGAA  ATAAAAATCA
146521  AATATCCAAC  AAAAAATATT  GACTATCTAA  TAGTATCTAA  GCTAGTAAAT  TTGGCCAGTT
146581  ATAAAATGTC  TTAAATTTTT  ATTTAAAAAA  AGAAAACCAT  ATTTATAAGA  AGAGGTGATA
146641  AAGAGAAATT  ATTTCAGTTA  TGAAGATTTT  GTTAGAAAAC  TATGAGAAAA  AAACTATTTT
146701  TTGTTTTCAA  AAAGTGAAAG  ATTAAGTTAC  CAAACAGTTG  CTAAAGAATA  CCAGATGGCT
146761  GAGCGTGGTG  ACTTATGCCT  GTAATCCCAG  TACTTTGGAA  GGCCAAGGCA  GGAGGATCAT
146821  TTTAGGCCTG  GAGTTCGAGA  CCAGCCTGGG  CACTGTAGCA  AGACCCGTCT  CTATTAAAAA
146881  AAAAAAAAAA  AAAAAAAAAG  AATACCAGAC  CTTGCTAACA  ATAGCAAAGA  TCAATTAATT
146941  CAAAATTTGA  AAAACTGTAA  TTTATTTAGC  TTTAGAGTAC  TCTCGTGATA  TGAGATTGCC
147001  AAATTAATAC  TTTGGGTGCA  TTTCTTTTCT  CAAAGGACTT  GCAAATTTAC  AAAGAAGTGT
147061  TGAAGAAAAG  CCACACATTG  GCAGGTAATG  TTTGCAAAAG  ACAGATCTGA  TGAAGAACAA
147121  TATTTTTAGA  ATATACAAAG  AATACTTAAA  ACTCAACAGT  AAGAAAATAA  CCTGATTTAA
147181  AGCAGGCCAA  TGACCTGAAC  ATCTGTTCAC  CAAAGAAGAT  ACACAGATGC  AAGTATGCAT
147241  ATGAAAAGAT  GCTTGACATC  ATGTCATTAG  GGAACTGCAA  ATTAAAACAA  GTAGATACCA
147301  CTGCATACCT  AGTAGAATGA  CCAAAATTTA  GAACACTGTC  AGCACCAAAG  GTTGCAAAGA
147361  TATGTAGCAA  TAGTAACTTG  TTCATTACTG  GTGAGAATGC  AAAATGTGCA  ATCACTTTGG
147421  AAGACAGTTT  GGTGGTTTCT  TACAAAGTA   ACCATACTTT  TACCATAAGA  TTCACCAATC
147481  ACACTCCTTA  GTATTTATCC  AAAGGAATTG  AAAACTTATC  TCCACACAAA  AACCTGCACA
147541  TAGATGTTTA  TAGCAGCTTT  ATTCATAATT  TATCCAAAAC  TTGGAAACAA  GATGTCTTTC
147601  AGTAGGTAAG  TGGATAACTG  TGGTACTTCT  GAATAATGGA  ATGTTATTTA  GAGTTAAAAA
147661  GAAATGCATT  CACTTTGGGA  GGCCGAAGTG  GGTGGATTGC  TTGAGGCCAG  GAGTTTGAGA
147721  CCAGCCTGGT  CAACATGGGA  AAACCCCAAT  TAGCCGGGCA  TAGTGGCGTG  AGCCTGTAAT
147781  CCCAGCTACT  CGGGAGGCTG  AGATATGAGA  ATCGTTTGAA  CCTGGGAGAT  GGAGGTTGCA
147841  GTGAGCCAGT  GCCACTGCAC  TTCAGCCTGG  GCAACAGAGC  AAGACTCCTC  TGTCTCAAAA
147901  AAAAAAAAAA  AAAAAAAAAA  AAAAAAGAA   AGAAAAGAAA  AAAGAAAAAG  AAAAAGAAAA
147961  GAAACGATCA  AGCCATGAAA  ACACATGAAG  GAAACTTAAA  TGTATGTTAC  TAAAAAGCCA
148021  ACCTGAAAAG  ACTGCATACT  ATATGACTCC  AACTGATGCA  GGGCAAGCAA  GCCAAAAATT
148081  AGGGCTTAGC  CCGGGAAGAA  TTCAAGGGTG  AAGTGGTGGT  GTTAGCAACT  TTTACTGAAG
148141  CAGCAGTGTA  CAACAGCAGA  ACAGGTACTG  CTCCTTGCTG  AGCAGGGCTA  ACCCATAAGT
148201  AATGTGCCCA  GAGTAGCAGC  TCAGGGGCAG  TTCTGCAGTA  ATATACCTGC  TTTTAGTTAA
148261  GTGCATGTTA  AGGGGGATTA  TGCAGAAATT  TCTAGAAAAA  GAGTGGTAAC  TTCGGAGTAG
148321  GTACAGAGGA  AGAAGTCGA   TAATGTCCTG  TTGTTGCCAT  GGCAACGAAA  AACTGACATG
148381  GCGCTGGTGG  GCGTGTCTTA  TGGAGAGGTG  CTTTAACCTC  GTCCCTGTTT  CGGCTAGTCT
148441  TCAATCTGGT  CCGGAGTAAA  GTCCCTGCCT  CCGGAGTTCA  CTCCTGCTTC  CTGCTTCACA
148501  ACTGTATGAC  ACTCTAGAAA  AGACAGTAAC  TATGGACACA  GTCAAAGAT   TAGTTGATAG
148561  AAATTGGGTG  ACAGGAAGTG  TTGAAAGGC   AGAACACAGG  ATTTTAGGG   CAGTGAAACT
148621  TCTGTGATAC  TATAATGGTG  AATACATGAC  ATTATACATT  TGTCAAAACC  CATAGAAAGC
148681  ACAACACCAA  GAATAAACCC  TAATGTAAAT  TACAGACTTT  CGTTGATAAT  GACGTGTCAA
148741  TGTAAGTTCA  ATTGTAATAA  ATGTACTACT  GTGGTGCTGG  ATGTCTATGG  TGGGGGGACA
148801  TTTTTGCTTC  AATAGTTACA  GTTGAAGTAA  ATGTTTGTGT  TTCCCACAAT  GCATATGTAG
148861  AAACTCTCAC  ATTCAATGTG  ATGGTCTTTG  GAGGTGGGCT  CTTTGGGTGA  TAGTTAGGTT
```

Figure 2 (Page 46 of 74)

```
148921 TAGTTGAGAT CCTAGCAGAT CGAGTCTTCA TGATGGGCAT GATGGGACTG GTCCCTTATA
148981 AGAAAAGACC AGAAAGCTAG CTCTCTCTTT GCCATGTGAA GACATAGCAG GAAGGTAGCC
149041 ATCTGCAAGC TAGGAAAGGG CCTTCACAAA GAATCAACTC AGACCTCAGA ACAGTGAGAG
149101 ATAAATTGTC GTTGTTTAAG TCACTCAGGC TGTGGTATTT TGTTTCAGCA GCCCAACCTA
149161 AGACTGTTAA TTGGATTAGA AATTTCCTTT TGGGGATGGT GTGTGGCGGG GGGTGCGGGG
149221 AGTACCTTTG TTAAGCTTTT ATATCAATGA GTTTGTAGGC TTTTCTTTTT TGGTCATTGA
149281 CTAGGACAGT TTAAATAGTA TGAGTGTGAA GGAGATTGTT GGTCATCTAT TCGATGTCCC
149341 TTCTCTGTTT TTTAATATGA GAACTCCTGA TTTTCAGCCA ACTACCCTGG AAAAAAAGCT
149401 AATCTTTCTG ACTTCTTAAG TGTGGCCATG TACTAAATTC TGGCTAATGC AAGGCAAGCC
149461 AAAGGTTTTA TGATAGGTTT TAGGACACTA GAGTAAAAGA GAGCTGTTGC ACACATGCTC
149521 TTCACCCTAC TTTTGTGTCC TTTTTTCCAT CCTACAACTT GGGTTGTGAG TATGATGGCT
149581 GGAACTTTAG TGGCTCTCTT GGATCCCAGG GGTAATTGAG GGGTGGCTGG AAGGAATCTG
149641 TGATTTTCTG GAGTTTCCAT ACACAAACAA GACCTGGATT TTCTGGGCTT CCCAGACTTC
149701 CACATCTAGA CTTGCTTTAA ATGGGAGAGA AATAAACTTG TTTCAGCCAC TGTCATTTTG
149761 GGCTATTTTA TAGAACTTAA TCTAATCTTC AAGGGTACAT GAATTGCTTT TCCTTAAAAA
149821 AAAAATCAGC CATAAAATCA TCTTCTTTTT TCTTTTGTTC CCCACATTAT TTAGTTGGAG
149881 CTCTGTAACT TTTTTTTTTT TTTTTTTTGA GACAAGGTCT TGCTCTGTCA CTTAGGCTGG
149941 AATTCAGTGG CATGACCATG GCTCACTGCA GCCTTGCCCT CCTAGGCTCA AGCAATCCTC
150001 GTCTCAGCCT CCTGAGTAGC TGAAACTAAG GCACATGCCA CCATGCCCAG CTAATTTCTT
150061 TTCTTTTAGA GATGGGAGCC TTGCCCAGGC TAGTCTCAAA CTCCTAGCCT CAAGTGATCC
150121 TCCCATCTCA GCCTCCCAAA GTGACAGGAT TACAGGTGTG AGCCACCATG CCTGGCTGCT
150181 CTGTAAGTGT CTGAATTTCA TTTTGTATTT ATCAGTCTGT TTAGATTTTC TTTCCCTTCT
150241 TGGGTCAGTT AGGCCATTGG TTTCTTTTTA AAGGTTTTCA AATTTATTTG CATCTAATTC
150301 TTCAAATTAC TCTCAAAATT ATTCCAGTAT ATATTCTTTT GTTCCTATTT TCTTCTGTAT
150361 TCTTTATTAA AATAGCTAAT GATTTATCTA GCAGGACTTA TATTCTTTCC ATAACTTTCC
150421 TGCACCCCAA TTAATCTCCA ATTTTATATT TCTTCTGGCC TTCCTTATAG TTTCCACAGG
150481 TTTATTTTAT TCATTTTTA AAACTTTTAT TTAATTGTTT ATTTTATTAT CATTCTTTCT
150541 TATTCAGCAA TCTAAGTGCT TAGGGATATA GAATTTCCTC TAAGCAGCAT ATGCTAGGCT
150601 TTAACAATGT TAGGGAGGCC TCCCCTTTCT GGGGAAGACC ACACTTACAT TAACACAGGA
150661 CTGTGGGATG CCAAGAGGTA GAGAAGAGCT TATGAATATC CAGATTACAT CTTCACTGAT
150721 CCTGCACAAA GGTGGGGTTC CTCGGTTACC CACTGGGTCC TATTACCCAA GTCTGGGTCA
150781 GCATACCGAG ACTACGGGTA TATAGAACAA GTGCAACTGG CGATAATCCT TCTGTTGGGG
150841 AGAAAAATCT TTTTTTTCTA TTCATCTTAG GTTCTCCATC TGTGGCCCTA TCAAGTAGAC
150901 TAACAAAAGA CAGATTGACA AGACAGAAAC AAAGCATGTG CATTGTACAA ACACAGGGGA
150961 GTACTGAGAT GAATACTCAA AAGAGGATTT AGAACTTGGG CTTATATAGC ATTTTAAGAA
151021 AAGAATACAT TTTTAAGTG ACAAGGAAGA CGAAAGGAC TTTGAGTTTC TAGTGCAGTA
151081 AATTGTGGGA AGGCAACTTT TTCTTTCCCT TTTTTTTTTT TTTTTTTTA AAAAAAGAC
151141 TTCTCTGGTG CTATGTCCAG GCTGATAAGA GTCTAAAGTC TCTGGTGACT AACTTTTGTT
151201 CTTCCCCGAG TAAGAAGACA CCTTCACAAT TTCATATCCT GCTTTTAGGC AAACAGGGAG
151261 AGGGCAGAGG TGTTTGTTTG TTTTTAATCT ATTTTTTTTC TCAATTGTCT TCAACTCAAA
151321 ATACTTCTTA TGCCAAAGAT GGCATATTCT GCTACCCTTC ACTTACTACT TACAACCCAG
151381 CCTCTATCAT CATAATTAGA ACTTCTGACC CTGGGGAACA TGGGCAATAG TTTGAACTCT
151441 TTTATATCTC CCTTAGGCAG AGATGGAGGC CCAGCCATGC CTCTGACATC TAGACACAAC
151501 TGTTGCTTCA TTTCTCCTAT TCTCAGAGGT GATGTTGTAG GACTTCAACA AATATCAGTA
151561 AACATTAATT TTTTTTTTCC TTGAGGCACA GCATGATCTT GGCTTACTGC AGCTGCTGCA
151621 GGCTCAAGCA ATTCTCCTGC CTTGGCCTCA CGAGTAGCTG GGTTACAGGC CCCTACCACC
151681 ATGCCCGGCT AATTTTTGTA TTTTTAGTAG AGACAGGGTT TCACCATGTT GGCCAGGCTG
151741 GTGTTGAACT CCTGACCTCA AGTGATCCAC CTGCCTCAGC CTCACATAGT TCTGGGATTA
151801 CAGGCGTGAG CCACCATGCC TGGCCATCAA TTTTTATGTC AACTCTAAAT TATAACATTT
151861 AGCAATTTTG TGACTTTTA TGGTCATCAT TAATGTTGTT TATGTTTTAG TTGTAGTCCT
151921 GTCATTACTC ACTCGGGTAT GGTAATTTGG TCTTTTTCAA AATGAAGTTA AGGTCTATTT
151981 GCTCTTCTCT GAATCATAAT AAGAACTGCC AACAGCCATT TCAGCAATAA CTATTTACTG
152041 AGATTTTAAA ATATTTCAAG GTAATTGGTC CTAGCAGACT GGAAAATACC AAATTCTTTT
152101 CCAGAACTGA ATCCCCATC AAAGTTCAAT TTTACTCATA ATTCCCTTTT CATTTGAAGC
```

```
152161 ATCTCATTGT AAGCCAGTCT TAACCCTTCT CTCACACTTT GCTTGGCTGT TTCTCAGGTA
152221 GAACTCAGTA AGTCTGGTAG CCTCCAGGAC TGCCGCTTAG ATTATTAAAC AACATGTCAG
152281 TGGTTGGAAG AGTCAATGTT ATTTTGATTT TTCTGTTTTG TTTTGTTTTA AATGCAGTTG
152341 GCGGATAATT GCAGCTTTCT TTCATTCCCT ACATGAGTTC AAATGGCAGC AAACAAACTA
152401 GGAGAACGCA GACCTTCTGA CTTGTGGGTA CCCCTACTCA TCACCTGAAG ACCCTTGGAA
152461 ATCAAAGCCC TGACCCATTA AAGACGGATG GAGACAGCAA CATACGATCA TCACTATTAT
152521 CTTGCTTTGC CCCAGTCCAG GTTAACCATC TGTGGTATTT TTAGTTGCTA AGTCCATATA
152581 TTCAACATAA ATCAATTATA TATCCACTAA AATCTCAGCA CTAGTCTAAC TACTAAGGAA
152641 ATGACAGCGA AGAAAACAGA CCAAACGTCT GCCCTTATGG GATTTATATT ATTTTCTCTG
152701 TGCTGGTTAA ACCAAGGAGC TTCTGCTCTT TTCCTTAGTC ACCTGGGGGA GGCAGAAACA
152761 AAGGAGAATA TTGATAAACC TGGAAATAGG GCCGGAGAGT ATCAGAGAAG GAAGCCTTCG
152821 GGAAAGTAAA GATGTGGCAG CCAGTATTCC CGTTATAAAA GGATACAACT CCGGCCTCAT
152881 AGTCCAGAAA AATTCCCACA AGCAGGGGCT GCTCATGCAG ATGAAGGGAA GTTGGGGGAG
152941 AAGTAAGTGC TACATAGCCT TTCTTTTTGC ACAGCCTGAG GGTCCAGAAT CCAGACTGAG
153001 GCTCTTGCTT CATGCCAGTG CCCCTCTGCA CATTTTCCAT ACAAACTCCT AAATCCCATC
153061 CGGTTCCTTC GCCAACATCC ACTTCAAAGT AACGTCTTCC TGAGGTGAAG CCTTCACAAC
153121 CCAAGACACA GGGGAAGGCA GTAAATCTCC TGGAAGATGT GTCCTGATTC TCCTGGGTGT
153181 ATCCACGAGT CACTTGTCTC CGATCCTCAG AGAGAATTAG TTCGTGATGA GCTGTATCTG
153241 GATCCAGAGT CACACTAACT GCAAAACAAA ACAAAACAAA CAAAATAAT TTTGTTGCTG
153301 TGAAGAACAC AGGTTATTTT ATTTTATTTT ATTTTGAGAT GGAGTGTTGC TGTCACCCAG
153361 GCTGGAGTGC ACTGGCACTA TCTCAACTCA CTGCAACCTC CACCTCCTGG ATTCAGGCAA
153421 TTCTCCTGCC TCAGCCTCCG GAGTAACTGC GACTACAGGT GCGCACCACC ACAAGTGGCT
153481 AATTTTTTTA AATTTTCTGT AGAGATGGGG TTTCGCCATG TTGGCCAGGC TGGTCTCAAA
153541 CTCCTGACCT GAAGTGTTCC ACCCACCTCG GCCTCCCAAA GTGCTGGATT ACACAGGTGT
153601 GAGCCACCAT GCCCAGCCAC AAGTTATTTT CAATAAAACC AGCCTGTGTT CAAACCCAAC
153661 TATTGTTTCT TATAAACTGG GTGAGCTTAG GCAAATCATT TAACTTTCTG AGCCTCAGTT
153721 TGTTAACTAT AAAGTGGAAA TTACCGTATT TGTTGCAGAG AATGGTGGGT AGGATTGAAT
153781 AAGCTTATGT TTGCTTAATG CTTGGTAAAA TTCCTGGTAC ATGGTAACCA CCTAATAAGT
153841 GGTAGTTGTT GGGGTGATCA GGCCCAACAC CAGGCCGTGG GGGCTACAAA GTCCGGCGGG
153901 GTCAAAGGAA TGAGAAAAGA CAAGTTAAGA GTGCATAAAG TGGGTCCAGG GTGCCAGCAC
153961 TAGATTGGAG GCTGCAAAGG CCCTAAGCTC TGGGAGCCCA CACTATTTAT TGGTGATCAA
154021 ACAAAGAAGC AGGTGGTGAG GACGTGAGGG TAAACAGGTG AGGGCATGAG GACATGGGGG
154081 TAGAAAGGTA GTGGTGCATT AAGCGTAGCT GTGACAGTTT AGCATTTTCT TTGACACATG
154141 TAGAATATAC TCTGCTGCTT GAGATAGTAG AGGACACGTT TATGAGTGAA AAGCAAGGAA
154201 CCAACAAGTC TGTGCACTTT CCAGAGGCTA TGAGGGGTTT TATGCCCTGA GCCCTGGGTT
154261 CCATCCAAGC CACAAGGGGT TTTATGCCCT AGGCTTAGAT TTGTGGTGCG GCAGGGCAGC
154321 CTTCCACCAT TTGGCACAGA GCTTGGTGTT CCAAAGGCCA CGAGGGGTTT TGGACCCTGG
154381 ACCCCGGACA TCTTCCAAGA CTCTTTTACA TTATGACAGA CAAGCCAGTC CTGCTTCAGC
154441 TCTTCTAACA ACATGTAGTA ATAATGATAT CATCAACATC ATCTTCGTCT TAATTATTCA
154501 AGGATGCCAA GGTACAGAAC TAACCTGTTA ATATGGTTAC CATCCTGTCC AAAGTTCTTC
154561 TCCCATGCAG GACTTCCAGG AATCATGAGA CAGTTGAGCA GAAAGATACC TTTTCCCTTC
154621 TCTACTGAAT AACCACCAAC ATTGAGAATC AGAGAGGGAA AATGACTCAG CTAATGTCTT
154681 AGCTTGTTAT TGGAAGACCC AGGTCTCATG ACACATGCCT AGTCCCATGA CTTTTAATTG
154741 TAAGCTCTTC TCTTTCCCCT CAGATAATGT TCCATAAGCA TTAGTATGAG ATAATAATAC
154801 ACTGAGGACC AATATACATG AAAAATATCA GACTAGAATC AAACAAGACA GAAAAAAGAT
154861 CTGATAACCT AAAGTGAGAT ACTGAACAGT ATGCAGTTTT AAAAATAAAA AATGGTAATA
154921 GGATGTTCTA ACAAGAGAGT TAAGAAACCA CTGTGCTACT GAGTTAAATG TTGATCAGTT
154981 GGTCTGTGAC AATTAAGGAA TTCAAGTATT CAGAAACACT TCCTGTGCTG GATGCTCTCT
155041 GTTTGTTCTT CCAAATAATC CCTCACTTTT CCCTGTCTTG CTCTGTGCCC AGGAAGGCTG
155101 ACATGGACAG ATTAACCAGG CTTTCCGCCC TCTGGCTTGG TTCAGCCAAT GGGAAGCACC
155161 AGAGGAGACC ATAGGGCACA AAGAAGCAGC CTTGGGAGTA TTCAGTACCC CAGTCCCACG
155221 CTATGATTTG GAGGGTCTGC ATTCCTCTGC CTCTGGGCAC ACTCTAGTAT AGTTACAGCT
155281 CCCTACACCT GCCACTTGAG GCCCAGAGGA GGTGATGGCT CTCTAACTGT TCCTAGTTCT
155341 GGGTGCTTCC TGTTCCTTGT GGATTTCCCA ACTCCTCACC TTTGTAAATA CCCTCCTTTT
```

Figure 2 (Page 48 of 74)

```
155401 TCAAACTCTA TTCAGTTAGC TTTTATCAGC CTGACTCACA GAAGTTTGGG GTTTCAATTC
155461 ATATTACCTG AATGACCCAG GAAAACCCAT GTTGAGAAAT TAAAATGTTT ACGGGGTGGT
155521 AATACCACTT AAGAGAAAAA ATATCAATTG GATTTTTAAA ATTCCACCTA TCTATTGGTG
155581 TGACACATCA ACAAAAACAT ATAGAAAGAT TGGAAGCTAA AAGATAGATA ATATAGTCAT
155641 ATACTGTTAT AGTATTATAT CAAAAGATAT TAAGTCAGAG CATTATTAAG AATGGAAGAA
155701 GGGCCAGGTG TGGTGGCTCA TGCCTGTAAT CCCAGCACTT TGGGAGGCCA AGGCAGGCGG
155761 ATCACTTGAA GCCAGGAGTT CAAGACCAGC CTGCCCAACA TGGCAAAACC CTGGCTCTAC
155821 CAAAAATACA ACAATTAGCT GGGCATTGTG GCACATGCCT GTAATCCCAG CTACTTGGGA
155881 GGCTGAAGCA CAAGAATCAC TTGAACCGGG GAGGCAGAGG TTGCAGTGAG CTGAGATTTC
155941 GCCACTACAC TACAGCCTGG GTGACAGAGA GAGATTCTGT CTCAAAAAAA AAAAAAAAGA
156001 AAGAATGAAA GGAGTCACCT AAAAAAGATA ACACAATTTT AAACATAAAT GTACTACATT
156061 ATTAGTGAAT TCATGTTTAG AATTGTGTTA ATATACAAAG CAAAAATTGT AGAATTATAG
156121 GAGAAATGGA CAAATCTACA ATCATCATGG GATGTTTTAA CATTCTTCTT TCCATAATTG
156181 ATAGATCAGG CAGACCAAAA GAAAGAAATA AGGGAAGATA CGGAAGGTCT GAACAATCTA
156241 AGAAGCGCAA TCTCATAGTC AATACATAAA GCTCAGCAAT TGTTTAATAA TAGTAAGCAG
156301 AGAATATGCA GTTTTCTCAG GTATAGATGG AACATGCACT AACTGAGTAA ATACTAGGCA
156361 GAAAACAGTC TGAACAAGTT TCAATAAATC TGTATTACAC AGATCATTTT CTCTAGCCTC
156421 AATATAAGAT TATAAACCAA TAATAAAAAG ATGACTAAAA AGATTCTAAA TATTAGGAAA
156481 TGTAAACTAC TAATAAGTCA TTAGAAGATG TATAGAATGG AACAATAATA AAATGTTATT
156541 TATAAAAATA TACAATGAAG CTAAAGCAGA ATTTTAAGGA AAATTTGTAG GCTTTAAATG
156601 CTTATCTTAG AAAAATTAAA AAGCTGAACA TTAATGAGCC AAGCATCTAA TTTAAATTTT
156661 AAAAAGAACA TAGAAAGCCA AATATAATTT TTTAAAAGA AAAAATAGAT ATTAAACAAT
156721 ATAACAGTGA AGTTAAAGAA AACAAGAATG CAATAAAGAG GAAAACAAA CAAAAAAAAA
156781 AGTAGCTTCT TTTAAAAGAA ATTTAATAAA ATAGACATAC CTCCAATGAG ATTTATCAAA
156841 GTAAGACAGA AGGCACAAAT GGAATGAATA CAGAAACTTT TTAAATATTA CAGAACTTTA
156901 TAATAAATCT TATGCTACTA ATAAAATTGA AAGTACTGAT AAAATTATTA CTTCCTAGAA
156961 AAAATATTTC TGAGTAAAAC TCACTCAAAA AACAAATAAA GCATGGGCAG ACCTAACATT
157021 AAAGAAATGA AATCACTACT TTAAATTTTA CCGACAGATA ATAAAACGTG CATCTTTATC
157081 AAGCAAAAAT GGAACTTGTC AGTTTTATAG GAAATTTAGA AGTCAAGGCA TGAGTAATGC
157141 CAATCTCATA CCAAATCCTA CAAAGAATAG AAAATTATGG CTCCCGCTTA TAGACATAGA
157201 TATAGAACTC CTGCACAAAA TAATATAAAT AACAAACCAA ATTTTATATT TGCAACTATA
157261 CATATTATAT GTGTATGTAT TATATATGTT AACATATACA TATATAATAT GTATAGCATA
157321 TGTTCTACAT ATTATATATG TATAGTGTAT GTATTTTACA ATATATAAAT GAAAACCCAA
157381 TCTTTAATAT ATTCATCTAG ATTGTCATAT ATGACATATA TAATACATTA CATCAAAAAT
157441 GTGTACAATA ATCAGGCCAG GCACAGTGAC TCATGCCTGT AATCCCAGCA CGTTGGGAGG
157501 CTGAGGCGGG TCAATCACTT GAGTCCAAGA GTTTGAGACC AGCCTGGTCA ATATGGCCAA
157561 ATTCCATCTC TACAAAAAAT ATGAAAATT ATCCAGGCAT TGTGGTGCAC ACCAATAGTC
157621 CCAGCTACTC GGGAAGCTGA GGTGAGAGGA TCACTTAAGC CTGGGAGGTG GAGATTGCAG
157681 TGAGTCGAGA TTGCGCCAGT GCACTCCAGC CTGGGTGGCA AAGGGAGACC CTGTCTCAAA
157741 AAAAAATTAA AAAATTAGCC AGGTATGGTG GCCTGTTCCT GTAGTCCCAG CAACTGGGGA
157801 GGCTGAGGTG AGAAGATCAC TTTAGCTCAG GTGGTGGAGC CATGATCGCA CCACTGTACC
157861 ACTCGGCTTG GGCAACAGAG TGAGACCCTG TCTCAAAAAA ACAAATATAT ACACACAGTA
157921 ATCAATATAT ATATTATATG TACCAATCAA TGCTTCACTT TTATATATAA TATAGATTAC
157981 ATCTTATTAG ATATATAGTA TTCCTTCTCC ATAGATAGAT AGATACAGAT ATAGACATAG
158041 TATCCTCTAT CCATATTAGA GAGAGGATAC TATATATATC TATAGCATAT AGAGATGCTG
158101 TCTCAAAAAA ATTTAAACAT CAGCCAGATG TGGTGGCCCA TGCCTGTAGT CCCAGCTACT
158161 GGGGAGGCTG AAATGAGAGG ATTGCCATTG ATCCTCTCAT TGGTTGAGCC ATAATCGCAC
158221 TACTGCACCA CTCAGCCTGG GAGACAGAGG GAGACCTGAG GTGAAGGAT ATAGATATAG
158281 ATATATAAAT AAATATGTAT AGAGAGAATA TAATATATGT GTGTATGTGT ATATATATAT
158341 ATTATGAAGA CACTGGGAGA GAATACTATA TATATATGTG TGTGTGTATA TATATATTAT
158401 GAAGACACTG GTGGGATGGT TCATTACCA ATTGGACCAA GAGTCCAGGT ATGGAGCCAA
158461 CATGCAATGT TGTTGTTGAC TGAGCTGGCA GAGCACTGGT CATAGTTACG GGAAAGAAG
158521 GTCTCCAATG AGACATACTT AACAAATAT ATGAACTTGC CATATACGTG GAGAGTTCTG
158581 GTGTGTATAT AGCCTTCTCT CACCAACCTA GCAATTGTCT TCATCATCAT TATAATGCTA
```

```
158641 TCAGAGCAAA GATGACAGCT AAATTTTTTT GTCCCTTTCT TCTTCTTTCT CTTCCTTCCC
158701 CTCCCCCACC TCTTTCTCTT CCTCCTCCTC CTTCATCTCT CTTCTTTTTT TTTTTGAGAT
158761 GGAGTCTTAC TCTGTCGCTC AAGCTGGAGT GCAGTGGCAC AATCTCAGCT CACTGCAACC
158821 TCTGCCTTCT GGGTTCAAGC AATTCTGCCT AAGCCTCCAG AGTAGCTAGG ACTGCAAGTG
158881 CACACCACCA CACCTGGCTA ATTTTTGTAT TTTTAGTAGA GATAGGGTTT CACAATGCTG
158941 GCCAGGCTGG TCTCAAACTC CTGCCCTCAA GTGATCCTCC TGCCTCGGCC TCCCAATGTG
159001 CTGGGATTAC AGGCGTAAGC CACTGTACCC GGCCTCCTCC TTTAATAGAC AGGGTCTAGC
159061 TCTGTTGCCC AGGCTGGGTA CAGTGGCGTG ATCATAGCTT ACTGCAGCCT CGAACTCCTG
159121 GGCTCAGGAG ATCCTCCTGC CCTAGTCTCC CCAGTAGCTG AACTACAGG CATAGCACAC
159181 GGGGCTAATA AAATTAATTA GGTGATAAAA TTCACTGCCC ACTGATGACT AAGCTCTTTG
159241 GACATAAAAG ACACAGACCT TGAAGGAAAA TGTGTCTACT TAATTTTGAA ACCCTATTTA
159301 TCAAAAAACA GGATGAAAAT GCAAATGCC ATCCACATGC CAGAAGATAT CAGCTATAAT
159361 AAGTTCCCAT AAATCAATAA GGAAAAGAAC CCAATAAAAA TTATTAAACC ACAGTAAATC
159421 ATGGGTAAAT CACAGAGGCC TGAAGGGCTA ATGGACATAC AAAAAGAATC TCAATCTCAC
159481 TAGTGAAATC AGAAAAGCAC AAATTAAGTA CACAATTAGG TACCATTTTA AATCTGTAAG
159541 ACTGTCAAAA TCATAAATTA TATAAGTAAA GACTCAGGGA GTTTTGGAGG AGTGAGAGCT
159601 CTTATATTGC TTGTGGGGTA GAATTGGAAC AATTTCAAGA TCTGTAGTAT CTGGTAAAAT
159661 TATGATATGC ATCCCTCACA CCAGCATGTC ACTCCAAGGT ATCTCCCTGG AGGGAACATT
159721 TACGGGACAC AAGGAAGCAT GGATAAGAAT GTTCACAGTA GTATTGTCTG CAACAGCAAC
159781 AACAACAAAA AAACCCAACT ACACACAACT TCAATGCCCA GTCCACAAGG CAATGGATTA
159841 AATAAACTTC AGGCCGGAGA TGGTGGTTCA TGCCTGTAAT CCCAACACTT TAGAAGGCCG
159901 AGGCGAGAGG ACTGCTTGAG CCCAGGAGTT CAAGACCAGC CTGAACAAAA TAAAGAGATA
159961 GTGTTTCTAC AAAAAATTTT TAAAAAATTA GCCAGACGTG GCAGTGCTTG CCTGTGGTCC
160021 CAGCTACTGG GGAAGCTGAC GTGGGAGGAT TGCTTAAGCC CAGGAATTTA AGGCTGCAGG
160081 GAGCCATGAT GGGGCCATTG CACTCCAGCC TGGGTGACAG AGTGAGACCC TGTCTAAAAG
160141 AGATAAGTAA ATAACAACTT TGCATTTTCT GCCACATTGC AAAATGGTGA GAGAGTGGTT
160201 TCTAGACTCT AGACTCTTTC TATGACTACC TTCTAGTTAT GAGATCCTAC AACACTCACC
160261 TAACCTCTCT GTGTCATATT TCCTCCTCTA TAAAGCAAAA ATGCCCCATA TAGAGAGGAC
160321 TGTGATATAA AACAAGAACC AAGAAAAGTA AAGCTTTTCT AATCTGTCAC AGACTAAAGA
160381 GTGCTCAGTA TATGTGAGTC ATTATTCCTG GTGCTGGTAG GAGTGTATGT TACAACTTTG
160441 AGTCAAGTAA TATGGTACCA TATATTAAGA TTAACAACAA CCTCGGCAAT CCCAGTTTGG
160501 GGTATGTTCC CAAAAGAAAT GAAAGCACCA GGATATAAGG ATGCATGGAC TAGAAAGTTA
160561 TTGTAGCAAC ATTGTAATAA CTAAGTTCTA AAAACAGCCT GAAGCTCCAT CAGTAGGGAT
160621 ATGGTTACAT ATATTTATTA TATTCTTATG GAATATTAGA CATAAAAAGT AACGAGTAAC
160681 ATAGAAGAGA CAGTGTATAT ATGTTACGTT TGTACAAACT TAGGGAAAGA TATAGATCAC
160741 CCTACCTAGA GAAGTCAGAT TGGAGAGGGG TGGGAAAAAC CTTGAACTTT CTCCTTATAT
160801 CCTTTATATT GTTTGACTGA TTAAAATGTA TTTGTTGCAT CTGCTTGAAG GCAATGTAAA
160861 ATAAAATAAA CATACATTTA AAAATAAAAA TAAAATTTAT CCTATCACT TTTGTAATAA
160921 AGCTGGGCAC AGTGACTAAC ACTTGTAATC CTAGCACTTT GGGAGGCAGA GACAGGCAGA
160981 TCACCTGAGG TCAGGGGTTT GAGACCAGCC TGGCCAACAT TGTGAAACCC CATCTCTACT
161041 AAAAATACAA AAATCAGCCA GGCATAGTGG TGCGTACCTG TAATCCCACG CTACCGGGA
161101 GGCTGAGGCG CTGGAACCCA GGAGGCAGAG GCTGCAGTGA GCTGAGATTG CGGCACTGCA
161161 AGCCAGCCTG GGTAACAGCG AGACTCCATC TCAAAAAAAA ATTTGAAAAA AGAAAAATTT
161221 TAATAAACAG TGTTTAAGAG GGGAGAAATA TTTAGTTAAA AGATAAGCCC ATTTAAGAAA
161281 TAGTTTCACT TGACCCGGAA GGCGGAGCTT GCAGTGAGCC GAGATCGCAC CACTGCACTC
161341 CAGCCTGGGC GACAGAGCGA GACTCTGTCT CAAAAAAAAA AAAAAAGAAA GAAAGAAAGA
161401 AAGAAATAGT TTCACTTGAA CCATATTATG ATTCCTTCTG TAAAGATGA GAGTAGGCAA
161461 ATTGACTCAG TGAAATCCCA GCAAACTTA CACAAGTCT TGTTCTTCCT TCCTGTCATC
161521 TGTATAGGAT GAAATACAGA GTGCTTTTGG GTTTTGTTGT TGTTTGTTGT TGTGTATTTG
161581 AGGGGAACAC AGGTCTATAA TTCCTTTTCT GAAATCCCTG AACAAAATG GGCTTTGCCA
161641 TTCAAATTAG TTTAGAAGTT ATAAAGGCAA AAAAATGCAT ATACTCTAAA GTTCAACCCC
161701 ATCATGGCCT AAGGCAGAGC CCTGTAATCA AATTCATCAA TATATCTGCA GCAAAACATT
161761 TATTCAAATT AAGTGGGATA AATAAAGACT TTAAATAGT CTCATCTCAG TGCCGTTCAG
161821 GGTTGGCCAC TGTGGAAGAC AGACTCAAGG GTGGCCTTCT ATGATTCCTG CCTCTTGGTG
```

Figure 2 (Page 50 of 74)

```
161881  TTCACACCCT  CGTAAAATTC  CTTGTCTTTG  AGTGTGAGCA  GGGCTTATGA  ATTGCTTCTG
161941  ACCAATAGGA  TATGGCAAAG  ATGATGGGAT  ATAATTTCTA  TGATTACGTT  TCATTATGTA
162001  AGACTCCATC  TTGCTGGCAG  ATTTTCTCTA  AAGAGTCTGT  CTCCTGAGCT  CTCTCTGAAG
162061  AAATAACTGG  CCATGTTAGA  AGCCCATGTG  CAAAGAGCTG  AGGGGTGGCC  TGTAGAAGCT
162121  GTGGGCAACC  TCCAGCCAAC  AGCCAGAAAT  AACCAGGGCC  AAAGTCCTGC  AACCATCAGG
162181  AAAGAAATTC  TGCCTGCTAT  CTCAGTGAGC  TTGGAAGTGG  ATTCTTCCTT  AGCCTAGCCT
162241  CCAGATAAGA  ACACAGCCTG  ACCAACACCT  TAACTGCAGC  CTTATCAGAC  CCTAAGCAGC
162301  AGGCCCAACT  AAGCTGTGCC  CAGATTCCTG  AACCACAAAA  ATTGAGATAA  CATATCAGTG
162361  TTGTATTAAG  GTTCTAAATT  ATGGTAATTT  GTTTGTACTA  ATAGATAACT  AATATAACCA
162421  CCAAATCATT  TCAGGTTAGG  CCAGATTTTT  GTAGCCAAAT  GAATCATGAT  AAAACTTTCC
162481  ATTTTCAGGG  GTTTTTTTGA  TTTTGTACTT  ACGGATACAA  ATTTGTGAAA  GTATAGTCAG
162541  CACTGATTTA  AAAAATCAAG  GGAGCAGGAA  ACTCAGTAAA  TGGTTCTAAC  ATTTTGGAAT
162601  CTGTAAATTG  GTTGTAACAT  TTGTCATCTG  TGTTATCTAA  GTCAAGTTCC  TAAAATATGT
162661  GAATGATAGG  TTATCATACT  CACCTACTTT  TCTTGCATTG  CTCTAAGAGT  TGGCTGAGCT
162721  ATTGATAATA  AACACTATGA  TCAGATCTAA  TACCATGATG  TGCTATTATG  ATCATGTGTC
162781  AGTCACAGGG  CTAAGCACTT  TGTACATGTT  GATGCATTTA  ATTTTGATGA  TAACTCAATG
162841  AAGTAGGAGC  TGTTAATATT  TTCATTTTTC  AGAGGGGGAA  ACCAAGTCAC  TTGGAGTAAC
162901  ATGGCTAATA  AGTGAAAGAA  TAAGAATTTG  AAAGGTTTGC  ACAGATAACC  AGAATGCAAT
162961  GCTCATCACA  TTCACTGAGC  AGTGAATCAT  ACTAACTAGA  GAAAGTATGA  AAGCTCTACT
163021  GAAATTAACT  AAACAACCTC  TCTGGCTGTG  AGCCTGCCAA  GGGACAGGTG  GTAAACTTGG
163081  TTACTGCATA  AGGCCCCTTC  TATCCACAGT  ATTCAGGAAT  TCTTTAGTGA  ACATACCTTG
163141  ATGACTCCTT  AACATTTTCT  TCACATCGAA  GTAAAGCTTG  AAACATTGC   ACATAGTATG
163201  AAGTTCCAAG  GAGACAGCCT  CTGATGTTTC  CAGCTTCACA  GCCCAACTCC  TAGAATAAGC
163261  AGAGGCGAGA  GATTTCTTCA  GAGGTGCATT  CCATTCATTT  CTATATACGC  ACACCCCTCC
163321  CCTCCTGCAT  TCAAACAGGA  CTTACCTGCT  CAAAGTGTCA  TTCACATTCT  ATAAAGAAAC
163381  AAAAGAAAA   GGTGAGCATG  GAACATCGG   TATTTCATGG  GGCTTGTCAT  GCAGGGCTAT
163441  TCTTCTTTGC  TTTACCCGAA  GAAGTAAAGA  GAGTTACCCT  AGTCTTAGTC  TTAGATATTG
163501  ATGGATACTC  AAACAAAGTA  ATTCCCACCA  GTCTTAGGTA  TTGATGGATA  CCCAGATGGA
163561  ATAATTCCTA  CCAGCTTCTG  GGAGATTCAG  CATGGCAGGA  TGTTTATCAA  CATTTGCATC
163621  TATTCTCATC  CTTGCTGAAG  TCTGAGGGCC  AGGAGCTTTG  TCCATGCTCC  CTCTGTAAGG
163681  ACTAGCTTTT  GGTGATCGGA  TTTCCTTCAC  AGTGAGCCCA  GATTAGAGAA  CACTTATCAT
163741  AAAGGTCCTT  AGTGGTGAAT  CTGTGCACAG  CCCTGAGACT  GGGCCACTGC  CACTAAGATG
163801  GTGGTAGCAG  GTATCACACA  GTGGTAAAGC  AATCATGCTA  TACACTCAGC  CTTACAGTAT
163861  AGTCACCAAT  CCTGTTAGTT  AGAACCAGAA  TTAATGGCTC  CAGATGTTTA  TCTTCCTACA
163921  GATAAAGCTG  TAGATTGTAC  CATAACAGCT  CTGGAGCAAG  GGTTCTACAA  GCAAATCAGG
163981  GAAAAGGTTA  TCACTCATTT  TGGCTGCCCC  ACTTCATCAC  CCATCAGTCA  CCTAGTGGAG
164041  TATTTCAGGA  GAGAGTCAAC  AACCAGGGTT  CTCTGCACAT  GGGCCAAGGA  GGCAAACAGT
164101  GGTAAATGTT  ATCCCGTGGT  TTCATTTGGC  CAAGCTGTGT  TCCCTCAGAA  GTTTATTTTT
164161  CTAATTGACA  TAAAGGTACC  CTATAAATTA  GTGAAGGCCA  GCCTGATGGC  ACTGATGTAC
164221  ATCTAAAAGA  AACATTACTT  TATCTTCCCA  TGCTTCCTTA  CCATTCTCCT  TTAATAGCAC
164281  TATAACATAC  CTTTTTTCCC  TACTCCAAGT  ACACAGCCTC  ACCTGCAGCA  ATTTCTGGGC
164341  TGAGCCCTGA  CATTTTTCCT  CCAGTTCCAG  GATGTGGCTC  TTGAGTTCAT  TGCTCTTCAG
164401  CCCCAGACCA  GCCTCATAGT  CCCTCAGTCT  ACTCAGAGTC  TGTTGTTCTT  CTTTCTCCAG
164461  CCTCCAGAGA  TAAGACTTCT  CTTCCTCATG  TAGGAAACAC  TGGAGATTCT  TAAAGTCAGA
164521  CCGGATTTTT  TGTCTCTGAA  TCTGTACCTT  CTCCTGGAGT  CAAGAAAGTA  TGGTCAAAAG
164581  GTGGAAGTAA  ACCAAATGTC  CATCTATGGA  TGAATGGATA  AACAAGAATG  AAAGTCTGAC
164641  ACACGCTACT  ACATGACAAG  CCTTGAAGAC  ATTCAAGCAA  AATAAGCCAG  AAACAAAAGG
164701  GCAAATATTG  TAAGACTTTG  CTTATACAAG  GCATCTGGAG  TAGTTAAGTT  CATAGAGACA
164761  GAAAGTAAAA  TAGTGGTTAC  AAGGTGTTGG  CAAGACCAGA  AAATGGACAG  TTATTGTTTA
164821  ATGGGTAGTG  AGTTTCAGTT  TAGAAGATGA  AAGATGAAAC  TGAGTTGCAG  TTTGGAGATG
164881  GGAATGGTGA  TGGTTGCACA  ACAATGTAAC  AATGTAAAAG  CACTTAATTC  TACTGAACTA
164941  TATACTTAAA  AGTGGTTAAA  TGCTTAAGTG  TTATATATAT  TTTCACACAA  ACACACACAC
165001  ACACACAATC  AGCCACTGGG  ACATTATTTT  CTCATGAGTC  ACTGAAGCTG  AAGAATGTC
165061  CCCAGTTTCC  TGCTGCAGAG  TCATGTGTGG  GAGGCAGGCA  CTCAGATGTG  AAGAGGTTG
```

Figure 2 (Page 51 of 74)

```
165121 CCTCAGATTC CTTATAGTCA CCCAATTAAT TTTCTTGTTC TTCAGCCAAG ACACAGGAGA
165181 AAGCTGGGTT AGGAGTGCTA GATAATTTAA TTGTGAAACT AGGGCCAAGT TCAAACACTT
165241 TATCAGTTAC AAGGATAAAA AGAGGTTTTT ACTTATGATT TAAGAAGTTA GATTTCTGAG
165301 TTGGAGCGAT TTTCTTGAAG TAAAAGCTTA TAATGAACAT CACCCAGACT GGATTTTAAG
165361 ACAACCAGGC TGGTAAGAGG GTCCATAATT CTTGGCAGGG GGAGCTTTGA GTGTGACAGG
165421 CATTTATTAT GGTTAACTGA GAAATACTGT TCTACTACCC TAGGGTCATC TTAAGCATTC
165481 CTATGTGTAA GACTGACAGA AATCAAGTGA AACTCTCATC TGAGGAGATG TAAAGTTGCA
165541 ATTTCCATTA GTGCTGTCTA AATTAATGCA GTGGGAGTGT GTATTCAGGG CAATTTGAAT
165601 CTATGTTCTT GGATTGCAGT CTTCAAACTT GGCCCAAATA AACTCTCTAC TTATCTTAAA
165661 AAAATAAAAA TTAAAAAATA AAAATAAATT CATACAGTGT TTTGATGACT ATGATATAGA
165721 AGAAGGGTCT TTGACTTAGG ATGAGGTGGA ATTTTTGTGT AGGAGACAGG TGCAGCTTTA
165781 ACTCTTGTAT AGACGGGTTT TCATATATGT TAGTTACAAT CAAGGTCTTC CCCATTGCCC
165841 AAGATCCTAG AAATGGGGGA AGTAAGAGTG TACTCAGGAG CTCAAGAGCA ACATCCACAA
165901 ACAAAGATCA GGGTAGAGGT TAGAGAGGAC TCCTGAAAGA GAGAAAATTG GTAATCAGCT
165961 TGTGGGATTT TACTGCAAGC TAGTGAATTA TATAAATATA AAGATTGGTG CAAAAGTAAT
166021 TGTGGTTTTT GCCTTTACTT TAATGGCAAA GACCGCAATT ACTTTTGCAC AAACCTAAAT
166081 ATTTCCATAA AAGAATGTGG CTCTGATAAT GTGGAGGTTA GTCAGCCACG GAAATAATCT
166141 GAAAGTTTGT AGTTGCAAGT GTGTAGGTTG TTGCATTACT TGTGATGTAC TTATAAATCA
166201 AGTATAGGCC GGGTGCAGTG GCTCACGCCT GTAATCCCAG CACTTTGGGA GGCTGAGGTG
166261 GGTGAATCAC GAGGTCAGGA GATCAAGACC ATCCTGGCCA ACATGGTGAA ACCCCGTCTC
166321 TACTAAAATA CAAAAAATTA GCCAGGCATG GTAGCACATG CCTGTAATCC CAGCTACTCA
166381 AGAGGCTGAG GCAGGGGAAT TGCTTGAACC CGGGAGGTGG ACATTGCAGT GAGCTGAGAT
166441 CGCACCACTA CACTCCAGCA AGACTCCATC TCAAAAAATA GTAATAATTT AAAAATAAAT
166501 AAATAAATAA AGTATATTTC TTTCATCAGC TTCATGAGCT TGAGTAGTAT GAATTTCAAT
166561 CTGGAGTGAT CCTGTTTTCT AAGTGTTCAC AAAGCTTGGT TTCTGTACCT GTAAAGTTGA
166621 GAGCCAGATG CTCCACTGTG GTAAAGTGC CAGGGTAATG AGTTGAGGCC TGCAAACCAG
166681 GTTTATTTTG AGGTATTTAA AGTTTGAGAC CCACTCGATG CTTTTTCTAG GTAAATAGTC
166741 ATACTAATTC TGCTTCTTCT GACTGAAGTA TCAGGAATCC CAGCCAACTA CAGTTTAAAG
166801 ATGGAAAGAT TGGTGCTAAA TACTCATGGA TGTAAACCTG GAACCAGGGG CATAAGTACA
166861 AATAATGGTT TCTTCCTTGG GTTTCATTTT TTCAATCTGG TTTAGTGAGA ATAAATCCTC
166921 ATTGTGCTTT TCCTCAATCA TCCCCTATGC CTAAGCTCTA GAATGGAAAA TAGCTTGAGA
166981 TCAATGAAGT CAGATTCTTA CTTTCCATTT AGTTATTCGC ATTGCTGTGG ACAGCTTCTG
167041 CTCCGTACAT CTGTCTTCAA GTTGCTTCAG TTTTGTCACA GCTTTCTGGA GCTTTTCCTG
167101 AAGGAAAAAT TTGATAAGTG AAGCCTATTC AATTTGACTC TTCATTAGGG ACCTAGGGGG
167161 AATCCCAATC TTCTAAGATA TATTTGAATA ATAGTGAATA TTTATAGAGT CCTCATTGTT
167221 TTTTGCTAGA GAGCATGCTA AAGGCTATAT GTGCAGGAAC ATACTGATCC CCTTGGCAAC
167281 CCTGAATAGT TGGTAGGATT TTAAACTTCA TTTCTGTGCT GTAGAAAATG AGACTAAGAA
167341 AGGGGTAAAA TAACTTGCCC AAAGGGCTAT GACTGCCAGG TGGTGGAGCA ACAATTGCAA
167401 TCTCATCTGC TGACCCAGAG CCTGAGCTAT GTCCACCACT AGAGTCCTGC CAGGAAAAAG
167461 TTGGATATAG AACAACGTAA TCATCATCTA AAAGATTTTG TAAAACAACA TGCTGAACCA
167521 AGCAAAACCA ATACCAGTGT TTGGCACACA TGAAATTTTG TGTCTTATGA GTCAGGAAAA
167581 ATCAGGATGC CAGCTGGTTA TTAGAAACAG TTCATGGAAG AGGGGAATTC TGGTATCTTT
167641 TGAACAATGG TATCATGAAT CCAATTTAAA ATGATTTAGT ATTCATGTCA AGCTTTTAGC
167701 TTATTCTTCA AAACAGTTTC TCATATTTCT ATTGAAAGTG ATTTGAAGCT GACCCAAATT
167761 GCTAATTGTA GTCAATGCTG AAAGAATTGT CTCCTGTCCT CTGTAAACCC AACAAGTATA
167821 CTCATTCATT CTCGAGTGTT CTCAGGAAAA GGTTCTATGT AACTGTTTTA GCAAAAGATG
167881 ACATTGTCCT TACTATATGC CAAGTGCTAT TCTATGCATT CTATATTTTA ATGTCCTCAA
167941 AGCTTATAAC CACCTCCTGT GTATGTGTTT TAGGGAGGGA GGACACTGCT ATTATCCCCA
168001 TTTACAGATG GAGAAACCAA GGTGTGAAGA CATTAAGTAA CGTGCCCAAA ATTGCCCATC
168061 TAGTAAGTGA CAAAACTCAA TTTCAACATA AGCTGGTTCC TTTTCTTACT ACTTGGTGGA
168121 AAAGTAATTC AAATGGGAAT ATGATCATCG CAGTTATTAG CTGCTCCATG GAGTTTAAGG
168181 AAGAGCTGCC ATGAGCTGAG TGGTGGTCAT GATTGACATG TCCTTAGAAG GACTTAGAGC
168241 CTTCATACAA GACCACCTCT GCCTCATGGA GGACAGAATA AGGAGCCTGA CACTGGAGAC
168301 AACATTTTCC TCAAATTTAG GCAGGACAGA GAAGGAAAAA GGACATCAGG ACTATGCCCA
```

Figure 2 (Page 52 of 74)

```
168361 TTCCTCCATG CTGCCAACAG CAAAGTCCCA CCTTCCTTAA TATGCTTTCT GGCAAGAAAT
168421 CTGGATGGTA CACAAAACCT CTCCCTCTGC TTCACCTTCC ACAACCAAGC ATTTCCAAAT
168481 CTTTGACTCT TCTTCCTGAA TCGTGCTTAA AATCTGCCCT CTCCTCCCTT TCTTATACGG
168541 ATAGTTTGAA TTTTACTCCT TGATATTCCT TTTATCATAG ACATGCCACA GTAGCTGGGC
168601 ACAGTGGTTC ATGCCTCTAA TCCCAGCATT TTGGGAGGCT GAGATGGGAG GGAGACCAGG
168661 GGTTTGAGGC CAGTATAAGC AAGAAAGGCA GACCATGTCT CTACAAAAAA TAAAAAAATT
168721 ATCCAGGTAT GGTGGGGCAT CCCTGTAGTC CTAGCTACTT GGGAGGCTGA GGTGGGAGGA
168781 TTGCTTGAGC CCCAGAAGGT TGAGGCTGCA GTGAGCCGAG ATTGCACCAT TGTACTCCAA
168841 CCTGGGATAC AGAGCAAGAC CCTACCTCAG AAAAAAAAAA AAAAAAAAAA AAAGTAGAGG
168901 TACCAGAGTG ATATTTTCAA TGTCACTGAC CCTTCATTCC CCAAATGAAA ATCCCCCAAT
168961 AGGTGTTCAA TTTTTACGTG TCCTTCAGGA GTTACTTCTA AGATGAACCA CTCTCTACCC
169021 TAAATGTCCC TCCCCACCAC CAAACCAGG GACCTCCAGG CAGACATTTT TGATGGTTTG
169081 TTTTCTTTAC TAGACTGTAG ATACCTAAAA GGTGATGGGT CTTTCTTCCC TGTTTTCAGG
169141 CCCTACTGCA TGGCTTTACA TATTGTGGTT TTTCAAATGA TATTCATGGT GTGAAACAAG
169201 AAAAAATGCG GGTGTTTGGT TTGAGAACAA CCTGTTCTAA AGCAAAAAGA AATTCATCAT
169261 AACACAAATG GATAGAGATA AGAGTCCAAC CATCCCATTG AAGGTCAGGA TGGACAGTCT
169321 AGATAATTGA GCAAGAAATC ATCATAAACT ATTTTTCAGA AGAATGACAT GATGAAAGCT
169381 GTATTTCCAA GTCATAATGT TAGGTTTCAA GTTAAATCAT CTCAGCTCCT GGGGAGCAGG
169441 ATAAGACTTG GTACTTACCA AAGCTCCCGG GCCCACACAC TCACCTTGTA GCCCTGGCAT
169501 ACGTCTTCAA CAAGAGCTGT GGTGTGCCCT TTGTGCTGTG GTGCCCGCTC ACAGCGCCAG
169561 CAGATGAGCT GCCCCTCATC TTCGCAGAAC AGGTGGAACT GCTCTCCGTG TTCCTCACAT
169621 GACATTTCTT GATCCGTCTC TTTGAGGGCT TCAATGAGGC TTCCCAGCTG CTTGTTGGGT
169681 CGGAGGCTAT CCATATGAAA TGGAGCCCGA CACTGGGGAC AGCAGAATGT CTCCTGCCTC
169741 AGTTGCTTTT GGCTTGGGTT TTTAAAGAAG TCTGTTATAC ACAAGTGGCA GTAGCTGTGT
169801 CCACAGTTGA TGCTTACTGG GTTCGTCATC AGGCTCAGGC AGATGGAGCA GGTGGCTTCC
169861 TCCATCATCT TCTTGGTGCT GGTGGTTGAG GCCATAGCTT TTATTGAAAA GCTCCAATAT
169921 TGGCTCTAGA GATGGAGATG AAGCAGCCAG AATTTTCCAC CGTGATGAAA ATACACCTCA
169981 CCTGCACCTC TATGTGATGA GCTGGCTGCA ACTGACTTCC ATAGGTCTTG AAGGTTTTCC
170041 TTCCAACCCC TATTATCTCA TTTTGTATTG AAGAAAGAG GACCTAAAAG GAAGAAGTTG
170101 AGGCTGAGGT TGTTTGGGCC ACGTTTGAGA ACTGCAACCC AAGTGCAGAG TTTCAAGTTG
170161 CCCTCATTAG CAAGCAGTTA CAAGTGGTTG TTTAGAGGAA AAAAAGCAGT TTAAAGCAG
170221 TTTTAAAGTT GTTTGCCAAG AATTTACATT AAAATAGCAT AAGCTTTTGA CTGGCTATAC
170281 ATTGTTCTTT GTATTACAAA TCTCGGGAAT ATGTAGGTAA TAGATGAGGC AGCCAGTCAG
170341 GAACAAAATG CTTTTAAACA TGGGGTCTTA ACTGAAGACC TATACTCCTG CCTCACTTGT
170401 CCTGATAAAT TTTGCATACC TCACATAGCT CAGACTGCTC TAAATTATTT CATTATTTTT
170461 CTTTTCTCAG TCTTCTAACT TTTTTTTTTT TTTTTAATGA GACGGAGTCT CACTCTGTCA
170521 CCCAGGCTGG AGTGCAGTGA CGCTATCTCG GCTCACTGCA CCTCCGCCTC CGGGTTCAA
170581 GCGATTCTCC TGCCTCAGCC TCCCGAGTAG TAGCTGGGTC TACAGGTGTG CACCACTACG
170641 CCCAGCTAAT TTTTGTATTT TTAGTAGAGA TGGGGTTTCA CCATGTTGGT TGGCTAGGAT
170701 GGTCTCGATC TCTCGACCTT GTGATCCACC CGCCTCAGCC TCCCAAAGTG CCAGGATTAC
170761 AGGCATGAGC CACCGTGCCC AGCCTCTTTT TCTTTTCTTA TAAGACAAGT TCTCGCTCTC
170821 TTGCCCAGGC TGTAGTGGAG GCAGTGGCA TGACCACAGC TCACTGCAGC CTCGACCTCC
170881 TGGGTTTAAG CAATCCTCCT GCCTCACCCT GGCAGAGTGG CTGGGACTAC AGGTATGTGC
170941 CACCATGTCC AGCTAAAGTC TTCTCTCCAG AAAGAAGAAA TGCATTGGAA TTTAGAGGAT
171001 ACACAAACAT CTAGCTGTAT AGCTAATACA GTAGCCACTA TCATGAGTAG GAATTTAAAT
171061 TTAACTTAAT AAAAATTAAA ATGAAAAAAT TCAGTTTTTC TGTTCCAGTT GCCACATTTT
171121 GATTGCTTAA TAGTTGCATG TGACTAGTGG CTACATAACA GCCTCAATAT ACAACATTCT
171181 GTTATCACAG AAAGTTACCT TGGACCAAGT GCTGGGAGAA GCAATGCAGG CTTCCTCACA
171241 AAAGCTGTAA AAGAGAGAAC TCAGGGAGTG TGAAACTCTT TCCTATTCTA GTTAACTTCA
171301 AGAATAATTG TTACCAGGCC AGCACGGTGG CTCACGCCTG TAATCCTAGC ACTTTGGGAA
171361 GCCGAGGCGG GCAGATCACC TGAGGTCAGG AGTTTGAGAC CAGCCTGACC AACATGGCAA
171421 AACCTCATCT CTACTAAAAA TACAAAAGT TAGCTAGATG TGGTGGTGCA CACCTGTAAT
171481 CCCAGCTGCT CAGGAGGCTG AGGAAGGAGA ATGACTTGAG CTCCGGAGGG GGAGGTTGCA
171541 GTGAGCCCAG ATTACACCAC TGCACTCCAG CCTGGGTGAA AGAGCGAGAA TCTGTCTTAA
```

Figure 2 (Page 53 of 74)

```
171601  AAAAAAAAAA AAAAGAATAA TTGGTACCAG AATTACTCTT TGTAATTAGT AGTAACACTT
171661  ATGCAATTGG GTGATCTGTG ACAGATTCCA TTGAAGGAGT ATGGGGAGCT TCACCCCAAT
171721  ATATGACTCC CTGGTATAAT GAGTATTTTG AATTAAAGGC CCTTAGAGAT CAGCAGATGC
171781  TGGAAGAGAC TTTTCCCCTA TCTACATAAA GACCAGTCAC ACTAGACAAG AAGAACAATT
171841  GTTTTTCCTT CCAACCCCTA TTATCTCATT TTGTACTGAA GAAAAGAGGA CTAAGAATGT
171901  AACCAGACCT AATCAGACAC TTTCACAAAA TAATGTCTGT CTCTCAGGCT CATTCATTTT
171961  CCAAAGAGAA CCATTTACAA GTTAAACTCT GTTCCTCCAT TCATTCATCC TCCCAAATAT
172021  TCATTTATTC TCCCTAGTAA TCATTTACTG CCCCTCAAAG AATTACCTAT ATTCTCCTGA
172081  TATCACCCTT CCCCTCTGAA ATAAATATGT ATACATGTAT AAACGTTATA CATACATATT
172141  TATACAGTAT ACATACATAT TTATACATAC ATACATATGC ATACATATTT ATATTTATGT
172201  ATTTATACAT AAGTATTTAT AAATAAGGCT ATATAAGTAT CTACCCCCAT TGGCAGAGGG
172261  GGTAATCACT CTGTGATTCT AGCCCATGTA CTTGTTAATA AATTTGTATG CCTTTTCTCC
172321  AATTAGCCTG CCTTTTGTGA GTCGATTTTT CAGTGAACTT CAGAAGGCAA AGGGGAAGTG
172381  TTCCCTTGGC TCCTACACCA TCATGACAAT AAAATTTGAC TCCACCTCGA CCCCCCCCAT
172441  CCCCCACAAA GAACAACAAC CAACACTGGT TAATAAGGTC GGTTGTTTTT TGTTTGTGTT
172501  TTTGTTGTTG TTGTTGTTGT TGTTGTTTTT GCTTTCAGGA GCAGAGGTAT AATAGGCAAA
172561  AGAAAGAGAA AGGAGAATAG TGAATACCTC TTCTGCAGAG AGGGGTGCCT AAGTGGGACT
172621  TCCCTGGCTA ATAACGTCTT GCTAGAGACC CAACCAGGAG GATAATGGAA GCAATCAAGG
172681  CAACCAGAAC AACCAGAAGA ACCAGTTTAT CCTTTTGTG CCCTCTCCCT AAACTGAGGG
172741  AATAAGAATT GGAAAGAAGG CTGCAGAGCA GAGGGTTTGC TCCTGAGGAG CAGTTATTTC
172801  TATGGGATCA GAGCTCCTGC AGAACTGGGG AGTTTACTTT TACTATCTCT TCTCCAGGAC
172861  AGGACCTATC TCAAGAGACA TGTTCAGAGT GATTGCAACA TAAAGAGTTT GCAGACCCAA
172921  GGAGGTAGGG AAGGCAGAAA GAAGATGGGG GAGGCCAGGG ATAGGCAACA GAGGAGTGAC
172981  CAGGAGCGAA AAAGCCTGCC TCTTCTGAGA ACCTAGCTGG GCTCTCCCTG TACCCCCGAT
173041  CCCTCCCCCC CGCCCGCCCC CACACCCCTA CTCCTGGGAG CTCCTCTAGG ACAGGGGCAG
173101  AGTCAGGAGG AAGTTTGAAG AGTGCCTAGA ATAAAAAACA GTAATTTAAC TACAATTACC
173161  GGGTAGGCTG TTTTCCTCTC ACAATTTGAT CAGTCTCTTG AAGCCACACA GAATTTCTTC
173221  TGAAGACGTG TATTCCTTGG CAGGCTATTT CCTCCAGTGA TACACCAGGC CCCTCTCTGC
173281  TGGGGTCACT GCTCTTCTGG GGAGATGGGG CTCCCCTCCT TCCAAGGCTC CAGGGTTCCT
173341  GTCCTGGGCC CCACTCATCT AAGTTCTGAA TCTTCTGAGA TTTGGTGTAA AGTCTGGTGA
173401  AAGAAAGAGC AGGAAAGAGG TGAGAGCTGT AAAACAAAGA AAGTCCTGAC CATTTTCAGA
173461  GTTGGAGGGG CCCTGCTGTC ACGAAATATA TTCCCCACCC CACTTGCCAT CAGTACACAC
173521  TCACATATCC ACTGAGAAAA CCTTAGCCTG GACCTTTTCC GTAACCTTCA CTGCTCAGAC
173581  ACTTACATAT TCGCTGCTAG TCCCCTCTGT TGCTGCCACT TCCTGGGTCA GGAAGTTAAC
173641  TCAGACCGGA TTAAACTGAG AAGTGAAACT ACTGTGGGAG GCGGGGCTCA TAAGATTTAG
173701  GAGAAAACTA GTGACGTTGT TCATATCATT TGCACTCCGC CTCTCCGGTA AAGGAGGGGG
173761  AAACGTAGGA AGAAAATATC CTTCTTTTAC AGCAATAAAA AGAAGGAACC AATTAATAAC
173821  CCTGTAAACT ATCATGTGAC CCCAACACAG AGTATCTAAA AACAGGAAGC CTGCAGAGGT
173881  TCAGTTCACA GACTCTGATT TGAGATCTTT CTACTTTTGC CACCAACTCC CTTGGGAGTC
173941  CTTAAGCCTT CCTAGCTGAT GTTACTTCTT TTGCTATTTA TGGGTTGCTT GTGGTTCTAT
174001  AACTGCTCTG AAGGGTGTGG TGGAAAAAGG GGTGGTAACA GCAGTAGGAC TCATTGGCAT
174061  CACAAAATTC ATCTGAGTCA GCTTTCTATT CTTCTCTGTC CCGTTCTGTG TCTTGTTTTT
174121  CTCCTTGCTG TCCTTCTGCA GGACTCAGAT CTTCTTCAAT AGCGAGGGTC AGCCAGGATA
174181  GAAAATGGGA GTCACTAGTG GCCCAGCAGT GAGTGCCCCC AGCTTAGAGC TGTGTGGGAT
174241  CCCTGGGACC ATCACTCTGC TTTGTGCTTT GTGGAGAAAA GGCTGTGGGG TCCAGGGTCA
174301  AGTCCTTAAT GACTTAGCTC CAGCTTCTCC ACTTCAAAAT GAAAGGAAAA GTACTATCAC
174361  CACCCGTTAG AATTATTATT TCATGGGGAA AAAAGATGGA TTACTATCTC ACAATAAGAG
174421  CTTGTCACAT TTATAAGTCT CAGGTGTAAG AGGCATTTAT GATAACAACA TAATAAATGC
174481  TGGCTTAAGT AGATGCAGTG GTCCAAGGGA ACCAGTAAGG GGAGCTCAGG ACACAGGTGG
174541  GAGGAGAAAT TAAACTTGAA TTCTGGGAGC CACTGGCCTG TCTGGGCCCC TGGCCTGCCT
174601  GCTGACCCTG ATAGCCAATG GAACATGGAG TTTGGCCCAG CTGCAATCCC TCTGGTCCAA
174661  CTACTCAAAA TAAAGGCAAG ATTGGGAAAC ACGTTCCTTT CTTCCTATAC CAAGCAGAAG
174721  ACTCTTCAGC ACTGCACCCT CCTGGGTGCT CACAGAGCCT TCTGTTGTTT TGCCACCTAC
174781  GATTCATCAT GCCCTGGCAT GATGGTTGCA GACCCCATGC ATAGCATGGG ACATTCTACT
```

Figure 2 (Page 54 of 74)

```
174841 CCTGAGGCAA CCAGCACACA GAGAGAGGAG AAAGAATGAG CCCCTGAATC CTTGGTCCCA
174901 CGATGAGTCC TTGCAGATAT CTACAACTTT CATTGTTGTG GATGTGACTC TGTACCCAGG
174961 CATGGCTCAT TCCAGATCTG TCCTATTGTC AGAGGTGTTC AAACCAGAAT GACTCCATTT
175021 TGAATGGGGG CTAGGTAAAA TAAGGCTGAG ACCTACTGGG CTGCATTCCC AGGAAGTTAG
175081 GCATTGTAAG TCACAGGATG AAATAGGCAG TTGGCACAAG ACACAGGTCA TAAAGATCTT
175141 GCTGATAAAA CAGGTTGCAG TAAAGAAGCT GACCAAAACC CACCAAAATC AAGATGGCAA
175201 CAAGAGTGGC CTCTAGTCAT TCTCATTGCT CATTATACAC GAATTATAAT GTGTTAGCAA
175261 GTTAGAAGGC ATTCCCACCA GCTCCATAGT GGTTTATAAA TACCATGGCG ATGTCAGGAA
175321 GCTACCCTAT ATAGTCTAAA AAGGGGAGGA ACGCTTGGTT CTGGGAATTG CCCACATCTT
175381 TCCCAGAAAA CATATGAATA ATCCACTCCT TGTTTAGTAC ATAATCAAGA AATAACTGTA
175441 AGTATCTGTA TTAGTCCATT TTCACACTGC TGATCCAGAC ATACCTGAGA CTGAGTAATT
175501 TATACCAGGA AAAAATGTTT CATGCTCTTA CAGTCCCACG TGTCTGGGGA GACCTCACAA
175561 CCACAGCAGA AGGCAAGGAG GAGCAAGTCA GGTCTTACAT GGATGGCAGC AGGCAAAGAG
175621 CTTGTGCAGG GAAATTCCTT CCTATAAAAC CATCAGGTCT CATGAAACTT ATTGACTATC
175681 ATGAGAACAG CAGTATAAAT TACTCAGGGA AAGACCTGCC CCCATGATTC AATTACCTCC
175741 CACCAGGTCC CTCCCACAAT ATGTGGGAAT TTAAGATGAG AGTTAGGTGG GGACACAGCC
175801 AAACCATATC AGTATCCTTA GTCCAGAAGC TGATGCTCTG CCTGTAGAGT AGCCATTCTT
175861 TTATTCCTTT ACTTTCTTGC TTTCACTTTA CTGTGTAGAC TTGCCCCAAA TTCTTTCTCA
175921 CACGAGATCT AAGAACCTTC TCTTAGGGTC TGGGTTGGGA CCCCCTTTCT GGTAACACTA
175981 TCAAGGATC AGGAAAAGGA AGCTAGTGAA TGCTAAAAAG GAAACAAACT ACCATTACCA
176041 ATAATAACAG CAAGACAAAA GCAAAACGGA TTGTGACAGC TGTCCCATCT CACACCTGTT
176101 TCCCATTGCA GGAAGGAGGG GCTGGTTCAT GCACAGAGTG GCCAATATTA GAAGCAGAGA
176161 GGGGGTGCAG ATGAGACTTC AGGAATATGT TGACAAAGGC AGGCCTAGGG AGAAATCAAC
176221 CTGAACTATC CCCAAGGAGG AATGCATTAT CTCTAATATG TAAAGTTAGG CTTGATCCTG
176281 TGATTATGGG ATATAGGAGT CCAAAGACTC ACAATGGGAA GTAGGTCACT AGAGTCTCCT
176341 TCAGAAGCTC TGTACTGTGT GTTCCCACTG TGGGCAAGAG TCAGCACTCA GCTATTCCTA
176401 GAATGCCTTT CCTCAACTCC TTCAGATTTT GCCTCTCAAC TAACCCTATC CTGACCACTT
176461 GTTAGCAAGT GTACCCCTCT CTCCCTCCCA AACATTTTCA AATCTATTTT GTTCCCATGG
176521 CACTTATCAC TGAATATTTT ACTAATTTAT TTGTTTAGT GTTTGCTTCC CTCATGAGAA
176581 TGCAAAGGGA TGGATTTTTT TCAATATTGT TCACTGATGA ATCCAGTAA CTAGAATATT
176641 TCTAAGCATA GTGATGTGCA TTAAATCAAA GAGTAACTTT CTGAATTGCA CTAAACACAC
176701 ATCACAAGAG GTGTGTGCAC ATATGTGCAT GATGCACGTA GTGTGGTGTG GGTGTTGTGT
176761 GGGGTATGTG GTACTGTGTG TGCTGTGTGT GGTATGTGAT ACATAGTTTG TGTTAGTGTG
176821 ATGCATGTGA TGTGGTATGT GTGTGCGTGT CCATACATAT TAGGGGTGGC GGGGATGTTA
176881 ATATGTCAAA TGGTACTAGA AAGTATCAGA ACTCATGGTG CTTACTGGTT TCCCAGAGAG
176941 CTGCTTCTCT CCCACCTGTA GGATATACTG ATGGTTTGGA CAGAGAAGAA ATAAAAAGAA
177001 GGCTGTGACC TACTGGGCTG AGGAAATAAA AACGAAAGTA AAGAAGAGC TGGGAAAAGA
177061 GAGTGGAGGG GCCAAGGGAA ATTTCCCCTT TGGCTTCTGG GGAAACTTTG CTGAAAAATC
177121 AACTCACAAA TTTATTAACA TGTACACAGG GAGAACCATA GAATGATTAT CCACTTCCCA
177181 AGAGGGCTTA AAAGCTTATA TATTATCCTG GCAAAACAGA TTATGGGAGG GGAAGAAGAG
177241 AAACTCTGTT GATGGGATTA CTGTTGCGGA TTTTTGCTCC TTCGCTCAGC TAGGTCCGGG
177301 TTTTTGTCTC ACAGCCAGGA AGAATTAGGC ATGCAGCCAT CAAAGAATGA GTGGAGTAGA
177361 ATTTATTAAG TGAAAGGAAA GCTCTCAGCA AAGACAAGGG TCCTGAAAGC AGATTTCTGG
177421 TTTGCTCTTC ACAGTTGAAT ACTAGGGCTT AAGACTCAAA TTCCTGACAA CTCCACCCTG
177481 TCCTACCAGT GCATGCAGGC CTTTAGACTG AGCTACTCCA TATTGATTAA TTTCCTGAAC
177541 TGCGCATGTG TTAAGGAAAG GAATCATCCA CTGCAGGCAT GTTTAGGCAA GCCCCTGTG
177601 CAAGTTCCCT TATCTGCACA AAACATCCGG TGTAAGCACT TGTGGGGCAG GTCAGAGGTT
177661 CTCTGGGTAC CATTCCCTTA CTGTCTGCCT AAAGCAAGCT GGCCAACTCC TTTCATTACT
177721 AGGGAGAGTA AGTAGATCAG GGAACAGAGA TTAACTTGAA CATTATCTTG TGAAAGTCCG
177781 TTCGGCATG GTTACATTCT TGGTCTTACA GGAAGGGTAA ATAAAAATAA TTGCTCTTTT
177841 TGGTGGGTCT GGATCTTAGG TAGATAAAGA AACTTTAATT CCACGATGTG TTTTGGTAGG
177901 GATAGTTGGT GGCAGGGATG TCAGAGAGAC TTTGAGGCTT CTTCAGTTCA ATATGACCAA
177961 GGGCCATATA TTAGGGTATC AATTTCTGAG CCCCAACAAG AGCTTAGGAG AGATGTGATA
178021 GCATCACAGT GTGAAAGCAA TTTTTTGTCT GTTTTTAGAG ACAGGCTCTT GCACTGTCAC
```

```
178081  CCTGGCTGAA GTACAATGGT ACGATCACAG CTCACTGTAA TCTTGAACTG GGTTCAAATG
178141  ATCCTCCCAT CTAAGCATTT CAAAGTGTTG GGATTACAGG CATGAGCCAC GGTACCCAGC
178201  CTGAAACTGC ACCCACTTTC TGATAAACTT TTCAAATGAC TAAAGGGGAG AGAGTAAGCA
178261  CTACTCAGAG GTAGGAAGAA AGGACACAGG ATTATAGGAT TAAAACAACA ACCACCAAAA
178321  AAAACCAGAC CGGTGTGGTG GCTCACACCT GTAATCACAG CACTTGGGGA GGCTGAGGTG
178381  GGGGGAGTCA CTGGAGGCCA GGAGTTCGAG ACCAGCCTGG CCAACATAGC AAGACGCTGT
178441  CTCTATTAAA AAAAAAAAAT ACCTGCCTTG AGCTAATCAG AATCATGGAC CCTGACAAAG
178501  GATGTCCCAA AGTAAGTCTT AGCATTTTTT TTTTTTTTTT GAGACAGTCT CGCTGTGTTG
178561  CCCAGGCTGA AGTTCAGTGG CGTGATCTCG GCTCACTGCA ACAGCTGCCT CCCAGGCTCA
178621  AGCAATTCTC CTGCCTTCA GCCTCCCAAG TAGCTGGGAT TACAGATGCC CACCACCACG
178681  CCTGGCTAAT TTTTGTTTTT TTTAATAGAG ATGGGGTTTT GCCATGTTAA CCAGGCTGGT
178741  CTTGAACTCC TGACCTCAAG TGATCTGCCC ACCTTGGCCC CTCCATAGTG CTGGGATTAC
178801  AGGCGTGAGT CACTGCACCC GGCAAAGTCT TAGCATTCTT TACAAACAGT TTGTACCCGT
178861  ATCTCTAAAA GGGAGTAGTG AATTTCACCC CAAAATATGG CTTCCTGATA TAATGAGTAT
178921  TTTGAATGAA AAACTCTTAG AGATCAACAG ACACTAAAGA GACTTTTCCC TAGGTACATA
178981  AAAATAGGAT GGCCCCACCA GCGAGAACAA TTGTTCTTTT CTCCCTCCCT GTTATCTCAT
179041  TGTGCATTAT AGGAAAGACC AAGAATGTAA CCACACCTGA ACAGACCCTT TTATAAGATA
179101  ATCAGTCTCT AAGCATCATT TAAATTCCAA GGAGAACTAT TTACAAATTT ATCTGTTCTT
179161  TGATCCAATT AGTCTCTCCT GGTAGTTACA TATTGCCCCT CAACAGAATT CCTCTTCTTC
179221  TGTTTCCCAT AACCTATTTT GCAAGGATCA AGCCCTGTT ACTTCTTCAA CTTCAAGTTG
179281  GCATATAAGC TTCTAAATTC CACTGGGATA TTGGTACTAT GTGCATGAGG AGAACCACAG
179341  AGTAATTAAA TTGTAAAGCC TTTTATCTTA TGAATCTGCC TTTTTTTGTG TTCATTTTTC
179401  AGCAAAACTT CCAAGGGCAA AGGTATAAAA CAAAAATAAA ATTCTAAAGC CCCCCAACCA
179461  TCTGAATAGA CTTTCTCTTC AGTCAGGCTT CTTAAAATGT AACCTGAAAG ACTGGCTCAG
179521  GCCATTAAGG GAAGTGGGGG TTGAACATGC CTCATTATTC CTCTCTGGCA TTAACATCAA
179581  CACAGCTTTT AAGTCTGATA AGAAACATTT TACAACCTAT TCTCTCTGAA GCCTGCTAGC
179641  TAAAAACTTC ATCCCATAGT ACAACTTTGG TCTTCACAAC CTGTTATCAC AACCTAGTGC
179701  TCCTTTCTAT TAATCCCAAA TCTTTATACA AACTCAACCA ATTGTCATCA CCTCCACCCC
179761  ACTCCTCCGC TGCTTCCAGT TGTCCCGCCT CTCTGGACCA AACCAGTGTA CATTTCTTAA
179821  ACGTATTTGA TTGATGTCCC ATGCCTCCCT AAAATGTATA AAGCCAAGGT GCATCCCAAC
179881  CACCTTGAGC GCTTGTTCTC AGGACCTCCT GAGGGCTGTG TCATGGCCA TGGTCACTCA
179941  AATTTGGCTC AGAATAAATC TCTTCAAATG TTTTACAGAG TTTGGCTCTT GTCATGACAC
180001  AGATGACTGC TTCACTGAAG CCTGCTCTGG AAGTGAGTGG GGGTTTTGCA AGGATAATTT
180061  TCCCCGGATA GCCCCAGAAG CAGCTAGTAA TAATACACTT AAAGGTAGCT AAAATGCATT
180121  GAACACTTGT TTTGTGCCAG ACCTATGTCA ACATTTGCTT TGTGCCAGGC TTATGCCAGT
180181  ACTCCTGATT TGTTAATACA TTCTAAATAA AAATTCTGGA GTTTCAAATA TAATAACTGA
180241  AAAACAGAAA ATAAATAAAA ATATATAATA ACTGAAATAA AAATTTACTA AGGCTGGGA
180301  TGGTGGCTCA CTCACACCTG TAATCCTGTT ACCGGAAAGG GGTCCGTCCA GATCCAGACC
180361  CCAAGAGAGG GTTCTTGGAT CTCACACAAG AAAGAATTCG GGCGAGTCTG TAAAGTGAAA
180421  GCAAGTTTAT TAAGAAAGTA GAGGAATAAA AGAACGGCTA CTCCATAGGC AGAGCAGCTC
180481  TGAGGGCTGC TGGTCGCCCA TTTTTATGGT TATTTCTTGA TTATGTGCTA AACAAGGGGT
180541  GGATAATTCA TGCCTCCATT TTTTAGACCA TATAAAGTAA CTTCCTGACG TTGCCATGGC
180601  ATTCGTAAAC TGTCGTGGCG CTGGTATGAG CATAGCAGTG AGGACGACCA GAGGTCACTC
180661  TCATCGCCAT CTTGGATTTG GTGGGAGCA GTGAGGATGA CCAGAGGTCA CTCTCATCGC
180721  CATCTTGGAT TTGGTGGGGT TTAGCCAGCT TCTTTACTTT TTTCCTTTTT TTTTTTTTTT
180781  TTTTTTTTTT GCCCAGGCTG GAGTGCAGTG GCACGATCTC AGCTCACTGA AACCTCCAAT
180841  TTCTGAGTTC AAGCGATTCT CGTGCCTCAG CCTCCCAAGT AGCTGGATT ACAGGCATGT
180901  GCCACCACAC CCAGCTAATT TTTTATATTT TTAATAGAGA CCGGGTTTCG CCATGTTGCC
180961  TACGCTGATC TCCAACTCCT GCGCTCAAGC CATCCAGCCA CCTTAGCCTC CCAAAGTGCT
181021  GGGCTTATAG GTGTGAGCCA CCCCACCTGG CCTAGCCGGC TTCTTTACTG CAACCTGTTT
181081  TATCAGCAAG GTCTTTATGA CCTGTATTTT GTGCCCACTG CCTGCCTCAT CCTGTGGCTT
181141  ACAATGCCTA ACTTACAGGG AATGCAGCCC AGCAGGACTC AGCCTTATTT CACCCAGCTC
181201  CTATTCAAGA TGGAGTCTTT CTTGTTCAAA TACCTCTGAC AAGCCCAACA CTTTGGGAGG
181261  ATGACACAGG AGGATTGCTT TAGCCTAGGA GCTCAAGACC AGCCTGGGCA ACACAGTGAG
```

Figure 2 (Page 56 of 74)

```
181321 ACCCCATCTC TAAAAAAAAA AAATACAAAA AAATTAGCCA GGCATGATGG TGTGTGCCTG
181381 TAGTCCCTGC TACTCAGGAG GCTGAAGTGG GAAGATGGCT TCAGCCCAGG AATTCAAGGC
181441 TGCATTGTCA GAGGCATTTG AACCAGAATG ACTCTATCTT GAATAGGGGC TGGATAAAAT
181501 AAGGCTGAGA CCTGCTAGGC TGCATTTCCA GTATGTTAGG CATTCTTAGT CACAGGATGA
181561 GATAGGAAGT CAGCACAAGG TACACATCAC AAAGACCTTG CTGATAAAAT AGGTTGTGGT
181621 AAAGAAGTTG GCCAAAACCC ATCAAAACCA ACATGGCCAC CAAAGGGACC TCTGGTTGTC
181681 TTCACTGCTC ATTATATGTT AATTATAATG TATTAACATG CTAAAAGACA CTCCTACCAG
181741 CATCATGACA GCTTACAAAT ACTGCGGCAA TATCTGGACT TTACCTTATA TGGTCTAAAA
181801 GGTGGAGGAA CCCTCAATTT TGGGAATTGT CCACCCCTTT TTTGGAATGC TCATGAATAA
181861 TCCACCCCTT GTTTAGCACA TAATCCAGAA ATAACTATAA GTATGCTTAT TTGAGCAGAC
181921 CACGCTGCTG TTCTGCCTAC AGAGTAGCCA TTCTTTTATT TCCTTACTTT CTTAATAAAC
181981 CTGCTTTCAC TTTACTGTAT GGACTTGCCC TAAATTCTTT CTTGTGTGAG ATCCAAGAAC
182041 CCTCTCTTGG GGTCTGGATC AAGACCCCTT TCTGGTAACA TCTTTCTGGT GACCACGAAG
182101 GGACAATACT GAGGAGACTC TGAAGCCAAA GGAAACAGAC TACAGCACCA ACTGGCTGAC
182161 TTTGGGTAAG TGGTGGAGTC CCCGGGTAAA GGATAGGATT GGGTTAGAGG TGCAACTTAG
182221 GGGAGATAGG GTCTCTCCTA AGACAGAGAG CGTTTCAGTC CGCTCTTAAT AAAGGGCAAG
182281 AATGCTTGAC CGAACTTGGG TTTGAGACCC AACTTAGGAA GGCTACAGTC CTTAAGATTT
182341 AAGGGGTTAG AGGCCCCTCT CAGTAAAGTC TCTCTTGGTT AAAAACGGAT TTAGCATTAG
182401 GGGATGTTAA CTGCTATTCT GTTTGTATTA ATCTTCCCTG TGCTCTTTGC TGACAGCTAT
182461 GGGTGACAGG ATTAGGCATG TACAGGATCA CGGGACATTG GAACTTTTC TTCTCTCCAA
182521 AAGGGGAAGC TTGACAGCTG ATAGGACTGT TGGAAAAGAT CCCTTTGCTA TGACAAGCAG
182581 CCGCCTGAAC TTTTGATTCA GTGTTGCTGC AATGGGTGGG TCTTTCTCTG GCCTCTGTGA
182641 ACTCCTCACC TTCCCCACCT CACCACAGGC AATGCTTTC TCCCTTTCTC TCTTTTCTCT
182701 TTTCTGTCTT TTCTGTTACT TGAGACAACC ATCTTGCCCA GAGACCATAT GTTGAAACTC
182761 CTGGTCAGAA GTTTGATTAA AGATGAAAGG GCCTATCTGG GGGCAAGTTT GAGCCTTCCC
182821 AGTTAGATAT TGGGTGCTAA GTGGAGTGGC CAATGTCTAT GTTTGTCAC ATGTATATTG
182881 CTCTGGCTGA AATGAAAAC GTTAATTTGG TTACTTTATG TGGCCATTGG GCAGCATCTT
182941 ACAAAAGTGA GAGACATTTA TTTGCCTGTG GTTCCATGAA ACAGAAAAAA GTTGGTTTTC
183001 CTTTGTGTCG TAGCTTGGAC CCAAGGGCTT TGCAGTGAGC AAGGTTGCTA GCGCTGCTCA
183061 GTGAAAGAGA ACCCAGAAAC CTGGCATGCC AGCAAAAGGG TAAAGATTTC TTACCAGTCA
183121 GGCTTCTGGC CTCTCTCTCT TAGTGAAAAC TGAATGAATG GTAAAAATCA CTGTTTATCA
183181 CCTCTGTAAA GTTTTGATTA ATGGGAACAA GGATTTGTGG GGCTAGTCTT AAGCTGTAAT
183241 GAATCTGGTA TACTTTGTGA TATCAATTTG TCTTTCTGTA TTACTCTGTC ATAAAGAGGA
183301 ATATGGTAGG ATAGAACATG GGCTTAGGAC TCCATAAGCC TGCTGTTCAA GCCAGCCCAG
183361 TAAACTGGTC CGTTGCAAAG TTTATTACAG GTCCCTGGAA AAAAAAAAAA TTAAAAACTG
183421 GATGAAGTTT CCTTCTCATC TTGTTTTATG TCCTTTGGAG CTTCACCTTG TAACCACGTG
183481 GCGGTACTTT CTCTTGGTCT CTGCCATCCA GGGAACAGGA ATTTTGGGGT TTATGTAATA
183541 GTTAACTCTA AAAATTATCT CAAGCCATTG CAAGCTCAAA ATTGGCTGCT CTGGACCCCT
183601 TCTGGGAAGG GCAATGGAAA CTAACCAGTG TTGTAGCTCA GCAGCTAAGG ATTTGTCATT
183661 TTATAATGGC GGCCAAGGTT CAATCCTGGC TTAGGGAATG AGTACTTTCT GATTGATATC
183721 TGTGTGACCT TTACCATTTG TTGATTCTGT TCTCTTCCCC TCCACACACT GTCTTGAGTT
183781 TTCCTCTCTC TGAGAACCTG GGAGATTATC TTTGGTAAAG TTCAAAAGCC AGAAATAATG
183841 GCCGTGTGGG ATGGCTAAAG TTGAGTAATA AGAAACTTAA AAGGACTCCT TTTTTTTTTG
183901 CTTTAGAGTG CTATGGTTTA TGGTTAAAAG CTTAATTAAA AGTGGATATT CAATCTCTAA
183961 AAGCCTGGGA CTCCTTGGGA AAAGCAGAGG AGGCACCACA GACCCCATTT TGGGAAAACC
184021 TCTGTTTTCC TCATGAAACC CCAGGAACTG GAAGTGGATA GATCCTTCGC AAAATCTAAG
184081 GCTCTGTTTG GCTTTGCATT ATGTTATCTG ATGTTTTTGA CTTTTGGGGG TATCAGAAAT
184141 TACTTTGCAT TATGAGGGAG ATCTGGTGTG TAATAACCAG GTAGGAAATA TACTTCTGGG
184201 GATAGCTAAA GGCAAATATA GGTGAATACT TGGCTATTTG CACTTTTGGA TCACAAGAAG
184261 CATTCTCTTG ACTACCTAGA AGGTATGGAA ATGTCTCCAT CCCCACCGAG AGATAAGATT
184321 CCCAGGGGAG ATGGCTGATC CCCCAAAAGA GGGCTGATTC CCTCTTTTGG GATCCAGGAT
184381 CTGGTATAAA AATGGGACCC TGGCCAGGCA CAGTGGCTCA CGCCTGTAAT CTCAACACTT
184441 TGGGAAGCCT CAGAGTTATG AATGTCTCAC CATACTGACA CTTTGTGACT GAGCTCCTCT
184501 CTACCCTGGA CACAAGAGAC CCTAATAATT AGACAGGAAT ATCATTGCCC CTATTTAGTC
```

```
184561 TGAAGAAGTT ATAGAAGATG GATCTTTATC CCACTGCAAT CCTTAGGATT AAGGGTTCCC
184621 TGGTAAAAGG GAGTGGGAAA ATATGTCAGA GGCATTTGAA TCAGAGTGAC TCCATCTTGA
184681 ATAGGGGCTG GGTAAAATAA GGCTGAGGCC TGCTGGGTTA GGTTAGGCAT TCTAACCAGG
184741 AGTTTAGTCA CAGGATGAGA TAGAAGGTTG CACAAGGTAC CCGTCACAAA GACCTTGCTG
184801 ATAAAATAGG TAACGGTAAA GAAGCCAGCT AAAGCCCACC AAAACCAACA TGGCCACAAA
184861 AGTGACCTCT TGTCATCCTC ACTGCTCATA TACACTAATT ATACTGCATT AGCATGCTAC
184921 AAGACACTCC CACCAGTGCC ACGACAGTTT ACAAATACCA TGACAACATC TGGACGTTAC
184981 CTTATATGGT CTAAAACGGG GAAGAACCCT TAGTTCTGGG AATTGTCCAC CTCTTTCCTG
185041 AAAAATTCTT GAATAATCCA TTAGTTTAGC ACATAATCCA GAAATAACTA TACGTCTGCT
185101 TATTTGAGCA GTCCATACTG CTGCTCTGCC TATGGAGTAG CCATTCTTTT CTTTTATTTT
185161 TATTTTTTAG ATAAAGACTC GCTCTGTCAC TCAGGCTGGA GTCTGGAGTG CAGTGACGTG
185221 TTTTGGCTCA CTGCAACCTT CACCTCCCGG GTTCAAGCAA TTCTCCTGCC TCAGCCTCCC
185281 AACTAGCTGG GACCACAGGT GGGTGCCACC ATGCCTGGCT AATTTTTGTA TTATTAGTAG
185341 AGATGGGGTT TCGCCATGTT GGCCAGGCTG GTCTCGAACT CCTGGCCTCA AGCGATCCAC
185401 TTGCCTTGGC CTCCCAAAGT GCTAAGATTA CAGGCATTAC CCACTATGCA TGACCCATTC
185461 TTTTATTTCT TAACTTTTTT TTGTTTTTTT GAGACAGAGT CTCACTCTGT CACCCAGGCT
185521 AGAGGCTGGA GTGCAGTGGT GCGATCTTGG TTCACTGCAA CCTCTGCCTC CTGGGTTCAA
185581 GCGATTCTTC TGCCTCAGTC TCCTGAGGAG CTGGGACTAC AGACATGTGC CACTACACCC
185641 AGCTAATTTT GTATTTTTAG TAGAGACAGT GTCTTGCCAT GTTTGTCAGG CTTGTCTCGA
185701 ACTCCTAACC TCAAGTGGTC TGCCTGCCTC AGCCTCCCAA AGTGCTGTGA TTACAGGCAT
185761 AAATCACTGC GCTCGGCCCT TCTTTACTTT CTTAATAAAC TTGTTTTCAC TTTACTGTAT
185821 GGACTAGCCC CAAATTCCTT CTTGTGTGAG TTCCAATAAC CCTTTGTGT GTGAAAGAAT
185881 TTATGGCTGC TGTTCAGGCT GGAGCAAGCT GGAGCTCATG CTGCTGCTCA GACTGGAGCA
185941 TGCGTGATCT GTGATCCCAG TAAGAGGATC ATGGTCACTC CAGCCTGAAC GACAGCATGA
186001 TATCTCATCT GTAAGAAAAA AAAAATTACT AGAGGGCTTT AACAGCAAAT TTGAGCAGCA
186061 AAAAGAAGTA ATCAGTGAAC TCAAAGATAG GTCAATTGAA ATGATCTACT CTGAAAAACA
186121 GAAAGAAGAC AGAATGAAGA AAAAGAAATA GAGCCTTAGA GACAGGGGAT ACCATCAAGC
186181 ATACTAATAT ATGCATAATG GGACTCCTAG AAGGAGAAAA GTGAGAGGAC AGGGAGAGAG
186241 AATGTTTGGA GAAATAATTT CTCAAAGCTT CCCATGTTTG GCAAAAAAC ATTAACTTGC
186301 ATACATATTT TAGGAGCTCA ATGAATTCCA AGTAGGATAC ACTCAAAGAG ATCCATACCT
186361 AGACACATCA TAATCAGATT ATCAAAAGAT GAAGAAGATG AATCTTGAGA GCAGAAAGAA
186421 AGGAACAATT CATCACATAC AAATAGTACT CAAAAGATGT CTGGAGTAGG TATACTAATA
186481 TCAGACAAAA TAAACTTTAA GATAAGCATT GTTATAATAA ATAAAGAAAG GTATTTGTA
186541 ATGATAAAAG TGTCAATTCA TCAAGAAAAC ATAACATTAT AAACATACAT GCACCTAACA
186601 ACAGAGCCCT AATATTCATG AAACAAAACT GACAGAATTG AAGGGAGAAA TAGAAAATTC
186661 GACAATAATA GTTGGAGACA TCAATACCTC ACTAGTTAGA CAAGATCAAC AAAAAAATAG
186721 AAGACTTAAC ACTTGAAAAC ACCTAACCTG ACCCTAACAT AAATCTATAG GTCACTACAC
186781 CCCAAAACAG CAGAATAAAC ATCCTTCTGA AGCTCACATG AAACATTTTT CAGGATAGAC
186841 TGTATATTAC TTCATGAAAT AAGTCTCAAT AAATGTAAAA GGACTATAAT AATAGAGTAT
186901 ATATTCTCTG ACCAAAGTGG AATGAAGATA GAAATCAATA ACTAGGCTGG GCGTGATGGC
186961 TCACGCCTGT AATCCCAGCA CTTTGGGAGG CCAAGGCGGA CAGATCACGA GGTCAGGAGT
187021 TTGAGACCAG CCTGACCAAC ATGGTGAAAC CCTGTCTCTA CTAACAAAAT ACAAAAATTA
187081 GCCAGGCCTG GTGGCATCTG CCTGTAGTCC CAGCTACTCG GGACACTGAG GCAGGAGAAT
187141 CACTTGAACC CAGGAGGCAG AGATTGCAGT GAGCTGAGAT CGCGCCACTG CATTCCAGCC
187201 TGGGAGACAG AGCGAGACTC CATCTCAAAA TTAAAAAAAA AAAGAAACT AGAAAATAA
187261 GAACAAATCA AACCCAAAGC AAGCAAGAGG AAAATGAAAA ATTTCAAAGC AGCCAAGAAC
187321 AAAAGGCACA TTATGTACAG AAGAACAAGT GTATAGATCA CATATTTCTC ATAGACACAA
187381 TATAAGCAAA AAGACAGTGG AGCAAAATTT TTTAGATTAA TGAAAGACCT ACAATTCTGT
187441 ACCAAGCAAA AAAACTCCCC CCAAATGAGG GTGAAATAAG ACAATTTAAT ACAGAGAAAA
187501 GAGGAAGGAA TTTATCTAGT CATATGTGAG AGTTTTATGA TACATTTTGT ACTGTATATG
187561 TGGATGTTTT CTATTTCATT TAAAAAATCA ACCGTGCAAT TAAATGGTAG ATTGTCTTGC
187621 TTCTTTTTGA TTGACACAGT CATTAACTAA AATATTGTAG TATTTTTTTA TCTCCCTGCC
187681 TAAAGGCAAT AAACATCTAA TCAGCAGACT AGAACAATAA AAAATATTTT TTAAAAGTCC
187741 TTTAGGCAGA ATGATAAAAG TCCCTTAGGC ATATTGAAAT TCCTATTTAT ACAAAGGAAT
```

Figure 2 (Page 58 of 74)

```
187801 AAACAGTACT AGAAATTGTA ACTATGTGAG TAAACAGATA ATATTTTTTC TCCATAAAAT
187861 GTGGTTGACT ATTTTCACAA AAATAGTTAA CAATGTAATG TGTGATTTAT AGCATTTAAA
187921 AGTAAAACAG GCCGGGCACA AAGGTTCGTG CCTGTAATCC CAGCACTTTT GGAGGCCGAG
187981 GCGTGCAGAT CACTTGAGGA CAGGAGTTCA AGACCAGCCT GGCTAACATG GCAAAACCCC
188041 ATCTCTACTA AAAATACAAA AATTAACCAG GCGTGGTGGT GCACGCCTGT AATCCCAGCT
188101 ACTCTGGAGG CTGAGGCACA AGAATCACTT GAATCCAGGA GGTGGAGGTT GCAGTGAGGC
188161 AAAATTATAC CACTGTGCTC CAGCCTAGGC AACAGAGCTA GACTCTGTCA CACACACACA
188221 CACACACAAA AGAAAAGTGT ATGACAACAA CAGTGCAAAA GAAGCGGAAA TGAAAATAAT
188281 GTTATTTTAT ATAAGTGGTA TACTTTTAGA TGAACTACGA TAAATTAATG ATGTATACTA
188341 TAAACTCTAA GGCAACCACT GAAATAATGA AACGAAGAAT TATGGCTAAC AAGCCACAAA
188401 AAGAAATAAA ATAGAATGAG AAAAAATATT TAAGTTGTTC AACAGATGGG AAAAAAAAGA
188461 GGAAAAGAG AACAAAGAAC AGATGGGACA AATGGGAAAG TAATAGCAAG ATGATAGACT
188521 TAACTCTACC CATATAGATT ATCACACTTA AGGTAAATGA TCTAAATACT CTAATACAAA
188581 AGCAGAGGTT GTCAGATTGA ATTAAAAAAA CAGACAACAA CAAAAAAAAG CAAAAAAAGA
188641 GCCACAACAT GCTGCCTACA AAAAATTCAC TTTAATATAA AGACACAAAT AGTCTAGAAC
188701 ACCATCACTT TTAACCTTAT TTACTCAAAC CTCCTAACTG ATCCCTATTT ATTTATTTAT
188761 TTATTTATTT ATTTATTTAT TTATTTTTGA GACAGAGTCT GACTCTGTTG CCCAGGCTGG
188821 AGTGCAGTGG CACCATCTAG GCTCACTGCA GCCTCTACCT CTCGGGTTCA AGCGATTCTC
188881 CTGCCTCAGG CCTCCCAAGT AGCTGGGACT ATAGCACATG CCACCATGCC CAGCTAATTA
188941 TTATATTTTT AGTAGAGACG GGGTTTTGCC ATGTAGGCCA GGTTGGTCTC AAACGCCTGA
189001 CCTCAGCCTC CCAAAGTGCT GGGATTACAG GCGTGAGCCA CAGCACCCAG CTCCTCTTCA
189061 TTTATTCTTG CTACGCTTCC TCCAATCCAT TTTGTGCATT TGATGATTTT GCCAGTAACT
189121 TCTTTATTTT TCTGGTAAAA TTACTTATGG GTCACTGAGG ACTGGGATGT TCTTTCTTCT
189181 AGAGGGGGTT TGTGTCTGCT TTTGCCAGGA AGCTGGGGTA CCACCAGTCA AGTATTACTT
189241 TAAACTCAAT TCATGAATTG AGACTTTTTT TTTTTTTTTT TTTTTACGC AGAGTCCTAC
189301 TCTGTCACCC AGGCTGGAGT GCAGCGGTGT GAACATGGCT CACTGCAGCC TCAACCTACT
189361 GAGCTCAAGC AATCCTTCTG CCTCACCATT CTGTATAGCT AGGACTACAG GTGTGTGCCA
189421 CCATGCCTGA CTAATTTTTT AAATGTTTTT TTTAGAGATG GGGCTCACTT TGTTGCCCAG
189481 GCCGGTCTCG AGCTCCTGGG CTCAAGTGAT CCTCCCACCT TGGTCTCCCA AAGTGCTGGG
189541 GTTACAGGCA TGAGCCTCTG TGGCTAGCCA AGACTTTTTA TTTTTTAGCC TAAATGTGTA
189601 TAAAAGTTGG CTTGTGGTTA CAACTTATCA GGATTGATGA TCTCTCTCTC TCTCTCTCTC
189661 TCTGTCTCTC CCCACCTCTC TCACATCCCT TGCTCTGCTG AGAAGCAGAG CAAACATTCT
189721 AGCAGTTTCC AGAGAGTAGG ATGGGATTAC TTCTAGTTTA CTTTTATCAT CCTTTGGGAT
189781 CGCAGTATTA CTGGGAGAAC ACAAGTATCT CTTATTAGAC ATACCACCTT TGTAGAATCT
189841 GGACTTTCAT TTTAGACTTT ATTTGTTTTC TACTATAAGC AATTTAAGTT ACAGATCTCT
189901 CTACACACTG TTTAAGTTGC ATCCCATGAA TTTTGATGTG CTTTATTGTC ATTATTATAT
189961 AGTACAATGT ATTTTGTAAT TTTTTGTGAT TTGTTTGGAG AGATTGATTA ATTAGAATGA
190021 TGTTTAATTT CCAAATATGT GTGTTTTTTT CCTACATTTC TTATTTTTAT TGATTTCAAA
190081 TTTATTTCTA CTGTAGTCAG ATTTAATAAT TCATTTATTT TTATTATTTT CATTTTTTTA
190141 GAGACAGGGC CTTTCTGTGT TGCCCAGGTT TGTCCCAAAC TCCTAGTCCC AAGCAGTTCT
190201 CCTGCCTCAG CCACCCAAAG TGCTGGGATT ATAGGCACGA GCCACCCGTG CACAACCAAC
190261 AATTCATTTA AAAAGTGGGC AAGTGAACTG AACAGACATT TCTCAAAAGA AGGCATACAA
190321 TTGGCCAACA AATATATGAA AGAATGCTCA ACATCACTGT ATTAGTCTGT TTTCATGCTG
190381 CTAATAAAGA CTTAACCTGA GACTGGGGAA TTTACAAGAG AAAGAGGTTT AATGGACTTA
190441 CAGTTCCACA TGGCTGGAGA GATCTCACAA TCATGGTGGA AGGCAAGGAG GAGCAAGTCA
190501 CATCTTACAT GGATGGCAGC AGGCAAAGAG AGAGCTTGTG CAGGGAAACT CCCGTTTTTA
190561 AAACCATCAG ATCTCGTGAG ACTCATTCAC TATCATAAGA ACAGCATAGG AAAGACCCGG
190621 CCCATAATTC AGTCACCTCC CACTGGGTTC CTCCCAGGAC ACATGGGAAT TGTGGGAGTT
190681 ACAATTCAAG ATGAGATTTG GTAGGGACA CAGCCAAACC ATATAAATAA CTAATCATCA
190741 GGGAAATGCA AATCAAAACC ACAATAAGGT ATCATCTCAC CCCAGTTAGA ATGGCTATTG
190801 TCAAAAAAAC AAAAAATAAC AAATGCTGGT GAGGATGTAC AGAAGAGGGG ACTCTTATAT
190861 CCTACTGGTG GAAATGTCAA TTAGCATAGC CATTATGCAA AATAGTATGG AAGTGAGGTA
190921 GGTTACATAG GGTGGTCACA GCCTCCCTTG AAAGGAAACA GAAACTTGT CAAATTGATG
190981 GAGAGAACAA ATCTCTTGAC ATTACACAAA CTGCATCTGG GGCTAGTGGT TAGAATATCC
```

```
191041  TCAGTCAAGG  AGGTAGAAGA  GCAGGAGGGA  AAATCCCTAA  GTTCGTGCAA  GTGCAGAAAC
191101  CCACAAGCTG  TGTTCTCAGG  TTGACATATA  CTCATTTTAA  TAGTAAGAAA  CACACCCTTG
191161  GGTAGAGAAT  TAAAATGCTA  ATAATACATG  TGATGTATGT  ACTAGCGTGT  ATGGCAATAT
191221  TGCATGCACA  TTCAAGAGAC  CACCCAAAAC  ATATTTAACA  ACAATGCCCA  TTCCCACCCC
191281  CTCATGGATA  ATCACGTAGG  ACTCCCATAA  CGGGAGTTTC  TTCAGTGTCA  ATTGGTGCTG
191341  AAGTAGCCGA  CCCTGACTCT  GCTATCAGCG  TGTACTTTCA  CCTTGCAATA  AACTCCTTTG
191401  CCTACTTTTA  CTTTGGACTG  GCTTTCAAAT  TCTTTTGTGC  AGGGAATTCA  AGAATCTGAA
191461  CCAGCCCACT  GACAACAGAG  GTTTCTCAGA  AACCTAAAAA  TAGATCTACC  AGATGAGGCT
191521  GAAAATCTGC  TACTGGCTAT  TTATCCAAAG  GGAAGGAAAT  CAGTATACAA  AGAGACACCT
191581  ACATCCCCAT  GTTTATTGCG  TCACTCTTCA  CAAGAGCTGA  TATATAGAGT  CAACCCTAAA
191641  TGTTCATTAA  CAGACAAATG  GATAGAAAAT  GTGGCATATA  TACACAATGA  AATACTATTT
191701  GGCCATGAGA  AGAATGCAAT  CTTGTCATTT  GTGGCAACGT  AGATGAAACT  GGAGAACATT
191761  ATGTTAAGTA  AGATAAGCTA  GGATTGGAAA  GATAAATACT  ACATGTTATC  ACTCATATGT
191821  GAAAGTAGAG  AAAAATTTTT  AGCTCATGGA  TTTAGAGAAC  AGAACTGTGG  GTACCGGAAG
191881  CTGGGAAGGG  TAGCAAGGAG  GGGAGGATAG  GGAGAGGTTG  GTTAATGGTG  ACAAAATTAC
191941  AGCTAGATTG  TAGAAATGAG  TTCCGGTGTT  CTGCACCATT  GTAGGGTGCA  TATGGTTAAC
192001  TCTCATTTAT  TGTATATTTT  CAAAAGCTA   GAAAAGAATT  TTGAATACTC  ACAACAAAAT
192061  AAATGATAAA  TGTTTAAGGT  GATGGATATA  CTAATTACTC  TGATTTGATT  ATTACACATT
192121  GTGTACACAT  ATAAAAATAT  CACTCTTTAT  CCCGTATATA  TGTACAGTTA  TTATATGTCA
192181  ACTAAAAATA  AAAGAAAAAA  AGAATATGAT  CTATCATGAT  GTATATATCA  TGTGTACTTG
192241  AGCAAAATGT  GCATGCAGAT  ATTGTGTATA  ATGTTCTATA  AATCAATTAG  CTCAAGATAA
192301  TAGATAGGAT  TGTTCAGATC  TTCTGTGTCT  TTACTGATAT  TTTGTCTAGT  TATTGCATCA
192361  TTACCAAAAA  AAGGGTGTTA  AACTCTCCAA  ATGTGATTGT  AGAATTGTCT  ATTTTGTCTT
192421  TTCTTTTCCA  TTTTTACTTT  ATGTATTTTG  AAACTCTGTT  ATGACATTTT  GCTATGTATT
192481  TTAAAACTTC  GTTATGTATT  TTGAAACTCT  GTTGTTAGAA  TCATACATTT  ATGATTATTA
192541  TGTTTTCTTG  ATGAAATGAC  CCTTTTCTAT  TGTCGTTGTT  TTTGTTTTTT  CTGAAATGGA
192601  GTCTCACTCT  GTTGCCCAGG  CTGGAGTACA  GTGGCACAAT  CTTGGTTCAC  TGCAACCTCC
192661  ACCTCCTGGG  TTCAAGCGAG  TCTCCTGACT  CAGCCTCCAA  GTAGCTGGGA  TTACAGGCAT
192721  GTGCCAGCAT  GCCAAACTAA  TTTTGTATTT  TTATTAGAGA  CAGAGTTTCA  CCACGTTGGC
192781  CAGGCTGGTC  TCGAACCTCT  GACCTCAGGT  GATCCGCCCA  CCTCGGCATT  TTTATTTTAT
192841  TTTATTTTTT  TGAGACAGAG  TCTCACTCTG  TCACCCAGGG  TAGAATGCGG  TGGTGTGATC
192901  TTGGCTCACT  GCAACCTCCG  CCTCCTGGGT  TCAAGCAATT  CCCATGCCTC  AGCCTCCCGA
192961  GTAGCTGGGA  TTACAGGCAC  ATGCCACCAT  GACTGGCTAA  TTTTTGTATT  TTTAGTAGAG
193021  ATGGGGTTTT  TCTATGTTGG  CCAGGCTGGC  AACTGACTCC  TTTAACAATA  CAAAATATCA
193081  CTCTGTCTCT  GGTAACACTC  TCTGTCTTAA  ACTCTATTTT  AGCTGTTATT  ATTATAGCCA
193141  TTTTAGTCTT  TTTATGCTTT  CTGTTTGCAT  AGTGTATATA  TTTTAATATG  TTTATTCTCA
193201  AGTTATCTGT  GTTTTTATAT  TTAAGATGTT  TCTCTTCTAG  CCAACGTGTT  TGGTTCTTGC
193261  ATTTTTAAGT  CGATTCTAAC  AATCTTTGCC  TTTCAATTGA  AATATTTACA  CCATTAACAT
193321  CTAACATTAA  CATTTATTTT  TCTTTCCACA  GTACACTGGC  TAGCATCTCC  CATATAATAT
193381  TGAACATAAA  GTGTGATAAC  TGACATCCTT  ATTTCATTCC  TACTCTGAGT  GGAAAGGGCA
193441  GGGGTGGAGA  AAGCATTCAA  CAATTTGCCA  TAATTATAAT  TCTTTTTGTT  ACACTGTTTT
193501  CTTCTGCATT  AAAAAATATC  ATTACATTTT  GCATGAATTA  TTAGGAGAAA  ATATTTTCCA
193561  ATTTTCCTGG  AAAATGCCAT  AACCACGTCT  CTCAATTTTG  TTTCCATCTT  TCTTCCACAT
193621  TTTACATAAC  CTACATAAGA  GACACATTAT  CAAGTATATT  TTACATGGCT  TCTCAGTGTC
193681  TTCTCTGTCT  GCTAACAGGT  TTACCAAGAG  ATGGCACTCT  TGTATTTCTG  GTGGCTATGT
193741  CCATATCGTT  TTGCCTTTAA  GACAGCGTAA  CTACTTCTTT  CACCAGTATT  AAAGACATGT
193801  ACATTTGATC  TGGTTCTTGT  GGATGATTTT  AAATGACTCA  AGCTAATAAT  CCTAATTTTA
193861  CCTAAACACT  CCATTATTTT  AAAATGTATT  CCTTTATGCC  CACAATAAAC  ATTTATTGAC
193921  ATTAGGCTGG  ACATTAGGCT  TCTCTATGGC  AGACATTAGG  CTGGACCCTA  GCCATATATC
193981  TATTGAGGGA  AAAAAAATTA  TTTTCTATAT  AAGTTTCCAG  AAAGCCAAGA  TGTGTTTTAA
194041  AAACAAAACA  AAACATTACA  TTCTAAATGC  TGTAACAAGA  TAAGAAAAAG  TGTTGAGGCT
194101  GAGAGAAGAA  CAAAGCAGCA  AGCAACTCCT  GGAAGGACCA  CTGCTGCAGA  GGTAATAACT
194161  GGTGAACCAT  GTTTTGGAGA  AGGAAAAGGT  CACCAAGAGA  AGGAGGGGGT  CCAGGGTGTT
194221  CAGAAAGATT  GCATGCATAA  AGATCAAGGG  TAATAAAAAA  AATTCCGTAT  TATGTAAATG
```

Figure 2 (Page 60 of 74)

```
194281 TGAAGTTCCA GGACCATGAG CTTGGAGAGC ATGAAGTACA GGAGGAGGGT TGGTTTCAAA
194341 TAAATCTGGG AATGAAACAG TGAAGCCTCT GGCAGAACTC ACATCTCTTT CCTCCCCTCT
194401 TCCTTGCACA TTCCCTTTAT GGAGTAATTG CAGGGATGGG AAAAGTTCAA AACCACCACT
194461 GAGCCTAGGA AGTGCTAGGG TAAAGTGGAG AATGAACCTG CGTGATTTGC TCATCCTAAA
194521 CTAGGTTCTT CTAGGAGAGC CCTTCCCCAT AAAATCTGCC CTCCTCGAAG GGGCCCAGAC
194581 AGCCTAAGCT CACCTCCCAA AGACCCCTTA CTTGCTGACT GAATCTGATT CCACCCAGAC
194641 ATGGCCTAAA ACCCTTCCAT AACTCTATAG CCAAATTCAA TTTTAGACAG GCCTCATACC
194701 AACCTTTCTT CCTCTAAGTC TGCCACCCTA GGCAATTCTC AACATTCTCT ACACACTTTG
194761 GGGCCATAGA CGTGCTACCA AGTCTCCAGA CCTAGACCTG ATGGAGCAGT GCTGTAATGA
194821 GACGACCACT GGCCTTTGAA CCAGACCCTT CTCTGTGGCT CCTATGCATC TCCAACCTGT
194881 TTTGAGCACT GCTGCCAAGA CATCTTTGGC ACTTTGTTGT GAAGTTTTAA AACTGAACTA
194941 ATCTACAAAA CACCTAACCT TTAAAAATTC ATTGTCATTT CATATCATGA AAGATAAAGA
195001 AAGGCCAGGA AACTGTTCCA GGTTAATAGA GACTAAAGAG ATAGCAACCA AATGCAATTT
195061 GTGATCCTGG ATTGAGGGGA AAAAGTGTTG TCAGAGACAT GATTGGGACA GCTGGTAAAA
195121 TTTGAATTTG AATTTAAAGA TAAAGTATTG AGTAATATAG GAAGATGATT ATCTGCAACT
195181 TTCAAATGTT TCAGTAAGTA TATATATATA TAAAGAGATA TAAAGACATA TAAATAAATA
195241 GATGGATAGG TAGAGAAAAA GCAAATGTAT AATATTAACA ATCTAGGTAA AAAGTATATG
195301 AGTGTTCTTT GTACTGTTTT TCTGATTTTT CTATATGTTT GAAATCATTT TAAAATAAGA
195361 AGGTTTTTGG GGTTTTTTTG TTTGTTTTTT GTTTTAGAG ACAGCATCTT ATTCTGTCAC
195421 CCAGGCTGTA GCTCAGTGGC CCAATCATTG CTCACTGCAG CCTCAACTTC CTGGGCTCCA
195481 GTAATTCCCC CTACCTCAGG CTCATGAGTA GCTGGTACTT CAGGTGTGCA CCACTGCACT
195541 CAGCTAATTT TTATTTTTA AATTTTGTA GAGATGGCAT GTTGCTATGT CACCCAGGCT
195601 AGTCTCAAAC TCCTGCCCCC AAGTGATCCT CCCACTTTGG CCTCCCAAAG TGCTAGAATT
195661 ATAGGCATGA GCCACTGCAC CCAGCCCCAA ATAAAAAGT ATTTTATTTT AATTAACTAA
195721 TTAATTTTGA GTCAGAGTTT CACCCTTGTC ACCCAGGCTG GAGTGCAATG CATGATGTT
195781 GGCTCACTGC AAACTCTGCC TCCTGTGTTT AAGCGATTCT CTTGCCTCAG ACTCCTGAGT
195841 AGCTGAGATT ACAGGTGCCT GCCACCATGC CCAGCTAATT TTTATATTTT TAGTAGAGAC
195901 GGGGTTTCAG CATGTTGGTC AAGCTTGTCT CAAACTCCTG ACCTCAGGTG ATCCACCCAC
195961 CTCGGCCTCC GAAAGTGTTG ATGAGCCACC ACACCCGGTC TAAAAAGTAT TTTAAAACCA
196021 CAGTCCCACT CTACCTTGTC CTACACTACC AGGGGCTAGG ATCACCCCAT GTCTTCTAGG
196081 CTATGAGATA GAGGAATCCA AGGAAGAAGA TAAGCTACTT GGTTCCTCTA TAGGGTCTTG
196141 TGTGTGCTCT CATGTGCTCT CTCTCTCTCT CTCTCTCTCA CACACACACA CACACACACA
196201 CACACACACA CACACACATG AATACCAGAG CTATCACTTT CCCAGTCTAG TACTCATCTC
196261 ATCCCAAGGG TTTTGTGTTG TAGTGGTTTG CTCATTTGTT TGTTTTGTTT GTTTGCTTGG
196321 ATTATTCTTT TTCTCTTTTT GCAGCTGAAG GGAGAATTTC CAGGCCAGCC CTTTGGCCAT
196381 TAGAGTTACA GTGCCTCTAT TCAGGCTTCA TAGAGAGACC TGGGATTCAG TAGTGGGGGG
196441 CTTTTATCCA GTTCAAAATA ATGCATTCTC ACCAAGATGT ACTTTGAAAT AAAACAATAC
196501 TAAAACACAA AATTTTATTT ATGCTGAACA TTGAATCACT TTTTTCTGTA TTTTGTGTAG
196561 AAAGTTATAC ACACACAAAC ACATTTGCTC CTGCTTTGTT TATTGGCCCA GGGGTATGTT
196621 TGGTAATACT TCATCAGGCA TGAGTAGTAC GTCTTGGAAG GTGTGGTCTA AAGCCTAGAC
196681 TCCTATCTGC TTCCTTCAGC ATTCTCCAGT GTATCTGTCA TCTGTCTACC TTAGGATGGG
196741 GTCTCCAGAA CTTCCATTCA CATTTAGAAG AGGGCAGCGG CTTTCTATGG AAAATATGAA
196801 CTCTCATTCA TCTCTATTCC TTCTTCTAGC TATGGTCCAG CTCAGCTGTT TGGAATAAAG
196861 TATCTATATG AAGTCTGCGA ATGGTTCTCA GACTGGTTGA ACATTAGAAT CACCTGAGTA
196921 CCTTCTAAAA TTCTTATTAC CCAGGGCATA TCTCAGAATG AGTACCACAG GGTAGGGATA
196981 GGATTAGGGA TCATGATCTC TGGAGTCTGG TTTAGGCACT AGTGCTGTTT AAAACTACGT
197041 TCATGAGGTG GAGGTTGCAG TGAGCCGAGA TGGCGCCACT GCACTCCAAC CTGGGCGACA
197101 GAGTGAGAGT CTGTCTCAAC AACACAAAAC AAAAAAAACC AACTACCCTT GTGATTTGAA
197161 TGTCCATCCA AAATTGAGAA CCATTAGGTA AGGCAAGCT GTATAATTAA AGAGCAGTTT
197221 TCATTTGTCT GGTGTGGTGG CAGCTTTTTG ATAAGGGAAG TATTGTTGCC ATCCACATAC
197281 CTGAGCCTCA CTCCTGAGAA CACTGGTGTG TATGTTGCTA AAATTCCCCA GGTGATTCTG
197341 AGGTTCCTTC CTGGATAAAA ACCACTGACC CTGGGAATGT ACCCACTGCC AATCTCCTGC
197401 GTAAACCTTG GATACTGGGA AGCCTACAGT TGAAAATATT GGGCTTGAGA TCCTGAAACA
197461 AATCTTGTAT TTCATTAAGA CTAATATTTG GTACAGTGCA GCAAATCAAG GGAATTTTGG
```

Figure 2 (Page 61 of 74)

```
197521 TGGCTGAGTT CTTTTAGAAC TTTTGCATTG AAATAGGTTC AAGCAGCAAT AAGTTAAAAC
197581 TACAACCTCA GCTAAAGGAT TAAAAGACAC GTGAGCTGGG TAGGATGAGG TCTAAGATTG
197641 GGTGTGGCGG CTCATACCTG TAATCCCAGC ACTTTGGGAG ACTGAGGTGG GTGGATCACT
197701 TGAGGTCAGG AGTTCAAAAC CAGCCTGGCC AACATGGTGA AAACCCATCT CTACTAAGAA
197761 TACAAAAAAA TTAGCTGGGC GAGGTGCCAG GCACCTGTAA TCCCAGCTAC TGGGGAGGCT
197821 GAGGGAGGAC AATCACTTGA ACTCAGGAGG CAGAGGTTGT AGTGAGCTGA GATCGCACCA
197881 CTGCACTCCA GCCTGGGTGA CAGAGCAAGA CTCCATTTAA AAAAATAATA ATAATAATAA
197941 CAATAATAAT AATTCAGACA TATCCAGGCA TCAAACAGAT ACCTGGGGCA GATGAATAGT
198001 CTTGAGATTC AAGTCACACA TGAAATTTAG GTGGAAAATG ACATTGGAGA AATTTGAGAT
198061 TATGATGAAT GGAAATTTTT CAAAGAGGAA TTTCAGGCTC TGTTCTTGAG GGGATAGATG
198121 GACTTCCAAC AGCAATAACA CAGGATTAAT GAGGACTTGG GATGTTACAT AAATTAGAGA
198181 TGTTAGATGG ATAAAGAGAT AAAAGTACTC TCTCTAAGAA CATGGGACCA GAGATAGGCT
198241 CACTTCTAAC CATCAGATAT AACTAGCAGA CTAAACGGTC TAAAAATAAA AATCATGCCC
198301 CACTCCTGCT TAAGACATTT TAATTACTCT CAGTAACTCT TCAGTTTTTC TACTGTGTTA
198361 TCTTTAACTA CAGGGTTGGT CTGGGTGTGC AACACAAGAA AGCCTGGCAT ATACATGGAT
198421 TCAAGTGTAT GCCATGTACA GGTATTCTTT CATGTACTAT TTCATGTATT CTTTTTCACA
198481 TCTGTTTTTT CCTTCATTGA AGTCAATGGC TGATATTAGA TTCTACTATT CATGTGTACT
198541 AGTTATATAT AATTGTTACA AAACAAATTA GCAAAACTT AGTGGCTTAA AGCAACACAC
198601 ATTTATTATT ACCTAAGGTC TGTGGATAGA AGTTCTGACA TGGCTTAACT GGGTTCCCTG
198661 CTTCAAGCCT CATGTGGCTG CAATCCAGGT GTTGGCTGAG TCTGAATTCT CATCAGAGGC
198721 TTGATTGTGG AAATTTCCAC TTCCAAGCTC CCTCAGGTTT GTTGAAAAAT TCAGTTCTTT
198781 GCACCGGTAG AAGCTTCTTG GTAGAGGCTG ATTCAACTTC TAGAGGCTGT CTGCAGTTCC
198841 TGTCACCCAG GGTGGAGTGC AGTGGAGCAA TCATAGCTCA CTGCAGCCTT GACCTCCCAG
198901 AATCAATCTG TTCTCCCACC TCAGCATCCT GAGTAGCTGG GACCACAAGT GTGTGCCATC
198961 ACACCTGCCT AAAAAACAAA CAAACGAAAA AAAACCCCCA GAGAACTTTG TAGAGACAAG
199021 CTGGTCTGGA ACTCCTGCGC TCAAGCAATT CTCCTGCCTT AGCCTAAAAG TTCTGGGATT
199081 ATAGGTATAA GCCACCATAC CTGGCATATG GCAAGTCTTG AGCAGGACAA ATACAGATGA
199141 TTTATGTCTG TCTTCCATGG TATTCTAGGT TATTGTTGAG ATGGTCCTCT ATTGTCTTGT
199201 TCCATCTATT GATTAGATAA AACGTTGTTC CTTCTGTTAT TTTTCAACAG TAGCTTTTAT
199261 GTGTCTCTCT TTATCTTAAA ATTCTAACCA AAGAGCTGCT CTTTTCTTGG TGTACTTTAC
199321 CTTTGGTTGA TCCTTCTTAA CCTCTTCTTG CCCTCTGGGG CCTAAGATGA GGGCTGTTAT
199381 CAGATGTGAG TCTATGGGAA AGCAAGCAAG AGGTTCTTCA GCCTCCGTTC AGCCTTAAAT
199441 GTCTAGGTAG AAATCAGTCA TGGCCCTTCC AATGTGGTAC AGACCAGATC ACAGAGACAG
199501 GGGTCTCAGC CAAGGTCTTG TGGCCTAAGC CTTATAGAAA TAATGAGTGT TTACTTACTT
199561 GGAGAACTCC CTTGGAATAT CTTTTTTTGT GAACCTGAGG CAACTTTTGG TGATTTCTTG
199621 ATGTCTTGGG AATCTTGGTC TAGAGCCATT TCAACCTGAT TTCTTTTCAT GTCAGTGGCA
199681 TTTTGTGACC AGATAGTAAA TAAGTTCTAT GATGTTCACT CAGAGAAATA CAATGACTTA
199741 TGATGTGAAG CTTCTGTGGT TCAGCCCTTA CTTCATCTTC ATTCCCTCTT ATCTGCATCT
199801 GTCTCCTGCT TGGAACAAA AGTCTGGCTT CATTCTATGA CCCCCACGTT GAGTTTCTTA
199861 GTAGCACTTA CTTTTCAATT AGGAGTGTCC TCACTTCTAT CCATCAGACA TAACTAGCCG
199921 ACTAAACAGT CTAAATATAA AAATCATGTC CTACTCCTGC TGAAAACATT TTAATTACTC
199981 CCCATCATTT AATTTTTCT ACTGGGTTAT CTTTAACTTC AGAGTTGGTC TTGTGTGCAA
200041 CACAAGAAAA CCTGGCATAT ACATGGATTC AAGTGTATGC CACGTGCATG TATTCCTTCA
200101 TGTACTATTT CATGTATTCT TTTTCACATC TGTTTTTTCC TCTAAAATTT ATTTCCTTTT
200161 AAAAATGAAA ATTTTGCATT TGACTAAATT TGTCAAATTT AGTCAAATTT GTTAAAACC
200221 ATTTTTAAAA TGTTTCCCGA AGTTTGAGT GAAGTTAGTA CTTCAGAAAA ACTGTTTTGT
200281 ATTTTTCATG TGACCTCAGT GCACTGCTGT GCATTCCAT TTCTGCGTCC ACACACATTT
200341 GTTTTGAGGA AATATAGGAA CGACAAGATA AAGTTCAAGC TCCTGGACAT TGCATAAAAG
200401 ACCGTCATGA CCTGGTCCTG TTGACTTCCC TAGATTTCCC GCTATTTCCT AAGTTGAGAT
200461 TTTTGGTTTG GATGCTTTGT GTTTTCCTAA AATCAAAATA GGTTTTTGCC TTTTATGATT
200521 ATACAGTAAA TAAATGCTAT TTGTGTGAAA CTTTAAACAA TACAAAAAAA ACCTAAGGAA
200581 GAAAGTCAGA TTCATCTAAA AATCCTTGTG GCCAGAATTA ACTACCTTAG TTATTATTTT
200641 CTCTATCTCT CTCTCTCAAT GTATATTTGG TGTAGGTATA GGGTGTGTG TAGTGTGTGT
200701 GTATGTATAT ATCTGTTTCT ATTCCTGTAT GTGGATGTGC ACAACGCATC CTGCTTTGTA
```

```
200761 CACTACAGTA CTAGCATTTT TCTAATGTAA TTCAATATTG TTGAAAACAT TTTAAAAAAG
200821 CTTGTATATA TACACACACA TACACATACA TGCATGTATG TACATATACA CATACAGACA
200881 AAAATGTATC CTATGTATAT TCACACATGT ATACACACTC ACACGTACAT AGAGTTTTAC
200941 ATCCATAGTT TATAAATGTT GCTTTTTTTT GGTCACCTTT TTGCTAAGTC TTACACTTTT
201001 TTTTTTTTTT TTGAGACGGA GTTTTGTTGT CATTGCCCAG GCTTAGTGCA GTAGCGCGAT
201061 CTCACCTCAC TGCAACCTCG ACCTCCCGGG TTCAAGCGGT TCTCCTGCCT TAGCCTCCTG
201121 AGTAGCTGGT ACTACAGGTG TGCGCCACCA TGCCTGGCTA ATTTTTGTAG TTTTTTTATA
201181 GAGACGAGGT TTCACCATGT TGGCCAAGCT GGTCTGGAAC TCCTGACCTC AAGTGATCTG
201241 CCTGCCTCAG ATTCCCAAAG TGCTGGGATT ACAGATGTGA GCCACTGCAC CCGGCCAAGT
201301 CTTACACATC TTTTTTTTAC CACTAAACTG TTTACCCAAA CCTGATAACC CAAGTCAACA
201361 GCTATTATGG CTCACACAAT CTTATGTAAA CAAGATACA GATATATAGA ATTTTCTTGA
201421 TTAATATTCA GAAAAAAATG GAGTCCCTTT ATACGTCCTT AGTATCTGCT TTACTCATTT
201481 AAAAATGTAT TACATTATAT GAAAGTATTC AGGTCAAATG TTATAGATGT GATTCATTCT
201541 TTTTAACTGT GTTATTTTC TGCAATGACT ATGTATCACA AAGTACTCAG TCTTCCACTG
201601 ATGAAAATTT GGGCTATTTC CAGTTTGTCT TCCATTTTTC TTTCTTCCTC TTGGATTTTC
201661 ACTCAATGTG TTTACTAATT TAGGAAGAAT CAATAGTTTT TATGGTATTA CTTCTCCCAT
201721 TCAAGAATAT AGCATATGGT ATAGTATAGT AGAGTACTTA GTTTAATTTA GCCAGATCCT
201781 GTTTTCTGCC CTTTAATAAA ATTCTATCAT TTTCTGCCTT TGAGTCACAT TTTCCTTGTT
201841 CATATAATTC TTAAAAAATG TATAGTTTTC ATTCTAAGGG AACATAAAAA CTTCTTTCCA
201901 TTTCTATTCC TGTCTAGTTA ATTCTACTAT TGGGAAAAGT AACTGTTAAA AAAAATTCTT
201961 ATCTTTCCAG TCAGTTCACC ACATTTCCTT TATACCTTTG TACTTTAATC CCCAGTCATG
202021 TTGAACACTT CTTATTCCTC ACACCAAGCC TCAACGGGTT TGCTCTTTCT GGAAGGTGCT
202081 TCCCCTGTAT TACTGACTTA TTCATACCAC ACATGGAGAC TGGCGCAGCC CTGTTCTGCC
202141 TGGGAAGCCT TCCCCTGATA CCCCTAGTTG GCAGGAGTCT TCATTTGTTC TTTTCTAGTC
202201 ACCTGTGCAA GTTTGTATTG TTCATGTTTA TCATCCTTCA TTCTAGTTGT CTGTCTCTAT
202261 GTGTGGTCTC ATTCAGTGGA CTCTGAACTC TTATGAAGTC ATGTCATGGG TCAGATCTTA
202321 ATAAATTAAT ATTGTCGGAA GCTAATGTCA TGTCTAGAAT ACAGAAAATT TATCAAAAAA
202381 AAATATAGTA TGTTGGCTGG GCGCAGTGGA TCAAGCCCGT AATCCCAGCA CTTTGGGAGG
202441 CCGAGGCAGG AGGATCACAT GAGGTCAGAA ATTCAAGACC AGCCTGGCCA AAATGGTGAA
202501 ACCTCATCTC TACTAAAAAT ACAAAAAGTA GCCAGGCGTG GTGGTGCCCA CCTGTAATCC
202561 CAGCTACTCA GGAGGCTGAA GCGGGAGGAT CACTTGAACC TGGGAGGCAG AGATTGCAAT
202621 GAGCTGAGAT CATGCCACTG CACTCCAGCC TGGGCGACAG TGAGACTCCA ACTCAAAATA
202681 ATAGTAATAA TAATAATAAT AATTGTATGG AATTGAACTG CTCTGATTGG AAATAGCTGT
202741 TTTTTAAAAA ATTATTATTT TTTAAGTTCC TGGGTACATG TACAGGATGT GCAGGTTGT
202801 TACATAGGTA AACGTGTGCC ATGGTGATTT GCTGCACCTA TCAACCCATC ACCTAGGTAT
202861 TAAGTACAGC ATGCATTAGC TCTTTTACCT AATGTTCTCC CACACCCCCA CCCCATCCTC
202921 CCCCAACAGG CCCCAGTGAG TGTTGTTCCC CTCCCTGTGT CCACGTGTTC TCATTGTTCA
202981 GCTCCCACTC ATAAGTGAGA ACATGAGGTG TTTGGTTTTC TGTTCCTGCC TTAGCTGTTA
203041 ATGTCAGGCC AGAGAGGCTT AAATTTTTAA GGATCTCTGG ACTTTTCTTC TACATTACTC
203101 TTGATGTTTA TAAATGTTAC AACTTCTTTA ATTTCATTAA ATGTATACCT TATTGAGTTG
203161 ATTTAACTGA GTTAACTTTG TTATATGAAA ATCATGATTG GGAGTGAGGG GGTTAAACCA
203221 GCTACAGAGA TCTTGATTGT TGGTGGTGAA GCAATGCAAG AATTCATTCA TTCAGTAAAC
203281 TAATGTTTAT TAAGCGTGTA CTGTCTTAGT CTGTTCAGAC TGCTGTAACA AAATATCATA
203341 AACTGGGTGA CTTATAAACA ACAAAAAATT TATTTCTTAC AGTTCTGGAG GTGGGAAGTC
203401 TAAGATTAAG GCCCTGGCAA ATTTAGTGTC TGGTGAGGAC AGGTAGCCAT CTTTTTGCTG
203461 AGTCCTAACA TGGCAGAAGG GTTGAATAAA CTTCCTTGGG TTTCTTTTAT AAGGACACTA
203521 ATCCTAGTGA TGAGGTTTCT GCCCTCATGG TATAACTACT GCCCAAAGAC CCCTCCTTCT
203581 AATATTATCA CTTTGTGGGT TAGGATTTCA ACATGAGTTT TGAGAGGATA CAGACATTTG
203641 GATCATAGCA CACACCATAG GACAGACACT GTGCCAAGAA TTGTGGATAT AGTGATTCTC
203701 AAAATGAACA AGATCCCCTC AGAGAGCTTG CAAAATCCAG CTATAAAATT ATGCTTTTA
203761 AACAAATTAT GCAGTTTGAA AAATCTACTC TGAATCTTAC TTGTGGCATT GAATACTTTC
203821 GGCCACTCTT TCCTTATTAT ATTAAATATT TACTCTTGTT TGGGGATCC AGTCTCACCT
203881 ACTTTTTCTA CCAGAACTGG TATCAGCTCA TGCTCTGCCT TATGCAAATT AAGAAAATAT
203941 CATACCTTTT GGGTAAATTA AGCCAAGAAA GTTCTCCTTT CTTCTCTTTC TCTCTTTCTT
```

Figure 2 (Page 63 of 74)

```
204001  TCTTTCTCTC  TTTCTCTTTC  TTTCTTTCTC  TCTCTTTCTT  TCTTTCTTTC  TTTCTTTCTT
204061  TCTTTCTTTC  TTTCTTTCTT  TCTTTCTTTC  TTTTTCTTTC  TTTCTTTCTT  TCTTTCTTTC
204121  TTTTTCTTTC  TGACAGGGTC  TTGCTCTATT  GCCTAGGCTG  GAGTGCAGTG  GTGCAATCTC
204181  AGCTCACTGC  AGCCTTGAAC  TCCAGGGCTC  AAGCAATCCT  CCTGAGTAGC  TGGGACTATA
204241  GGCATGTGCC  ACAACATCAA  GCTAATTTTT  GCATTTTTTT  GTGGAGACGG  GATCTCCCTA
204301  TGTTGCTAAG  GCTGGTCTTG  GATTCCTGGG  CTTATGCGAT  TCTCCTGCCT  CAGCCTCCCA
204361  AAGTCCTGGG  ATTACAGGCA  TGAGCCACTG  CCCCTGGCCA  TTATAACTAT  TTTCATTGGC
204421  TTATCAGGCA  CATGATAACT  ATAATAAATC  AATAACCAGA  ATTTTTAAAT  AAAGAAAGGA
204481  AGGAATTGTT  TCAACTCTTC  CTGCTACCCC  TCTATCCCTC  AAAAGGGTAG  GCTGAATGTT
204541  GTCCTCCAAA  GATATCCATG  TCCTAATCCC  CAGAACCTGT  AAATATATTA  CCTTATATGA
204601  CAAAAGGGAC  TTTACATGTT  TAATAAGTTA  AGAATTTTGA  GATGGGCAGA  TTTTCCTGAA
204661  TTTTGCAGAT  GGGCCCTAGT  GTAATCACAA  GGGTCCTTAT  AAGAGACAGG  CAGAAGAGTC
204721  AGAATAAGAG  AAAAATACTT  CAAGATGTTA  CACTGCTGGC  TTTAAGGTGG  AGGAAAGGCC
204781  AAGAGCCAAA  AAATGCAGTG  GTCACTACAA  GCTGAAAAGA  AAAAGAAATG  GATTTTCCCC
204841  TAAAGCCTCT  GGAGGGGGCA  CAACCTTGCC  AATACCTTGA  TTTTGGCTCA  GTGAAACCCA
204901  TTTTGGACTT  CTGACCTTTA  GAACTGTAAA  TAAATAAATA  ATTTTGTGTT  GTTTCAAGCC
204961  ATCACAGTTG  TGGTAATTTA  CTACAACAGC  AATAAAATAG  AATTAAATAC  AGAGATCTGA
205021  GGAGTTGAGT  AGGATAAGCC  TACTCCAGCA  GGTTATTTCG  GGAGTATGGT  GAGACTCACT
205081  AGGATGGCGG  AACTCAATTA  AGGAAGTCTG  AAGCTGATAA  GCCAGAGAGG  GAAGGCTCTC
205141  ACTTCATTTT  ATAAGGGTTG  CGTCACACTA  GGAAGATCCA  ATAGCAACCA  CAGTCTCAAA
205201  ATTAATGATT  ACAAATAGGA  CACAATTCCA  AGAGTCGGGA  GCCAAGCAGA  AAATGGATTA
205261  GGGAAGACAT  GGATGATATG  AAACAGGAAG  GAGGGGTACA  AGGCAGCTTC  CTGGGAAGTT
205321  GCCAGGGCAG  TCACAGTTCA  CATTCATTAG  GCTGTGGGCA  CCAAATGCAT  ATGGAAAATC
205381  TAGCTGACTT  AACTGAACTC  CTGAAGAGGA  ATGAACACCT  CATTTATTGA  GGAGCTACTA
205441  CCAATTAGAA  TATGTATTTC  ATTTGTTCAA  TAACCCCATG  AGTACAGTAA  CACAATCCTT
205501  GCTTTACTAA  AGCGGAAGCC  AATTCAAAGA  GGTTCAGTGA  CTTGTCCAAG  CTCAGGGAAA
205561  ACACTAGGAA  GTGAATATGG  GTCTGACTCC  ATCACTGATT  TCAGGAGCCC  TGCCCTTTCC
205621  TCCACACCAT  GCCCCCTTGC  TTTCAGAAAA  AAAGGCTTGT  TGACTGAATG  GTTGTATGCA
205681  CAGTTCAAAG  CAGAAACACA  CGATGACATC  TTTTGAGATA  CTCTAACAGT  GAGAACTTGA
205741  AAATGAAGTT  AAAAATTAAG  CGGCAAAACC  AAGCCGAGGC  TTTCTGAGAA  AGTGGGGCCA
205801  AACCTGTTGC  CGTCTGACTG  CCACGTGGCT  CACTATTTAT  CCCTGTAAAA  ATCTGCAAAA
205861  GTATTTGAAA  GGGAAGAAGG  GACAGAAAAC  TCCCTCCTTT  TCCAAGTTAG  CCTTATAGTC
205921  TAGGGCTTAA  AATACTGGTT  TAATGGTGAA  GGTAAGTGCT  TTTCTTCTTT  TTGGGTAGAA
205981  GGATTATTAC  TAACTTACCA  AAGGTCCATT  AAGGGGAGGG  AACAGTTTTA  GGAGAAGTCA
206041  GAGAAAAGAC  ATTAACAGCA  ACATAAGGAT  CTCCATCTGG  TAATATTGCC  TAATTCCAAA
206101  ATGAAGAGAC  TCTCTGAAAA  AGATAACTGA  TTCAATGAAG  ACCCTAGGGC  AAGGCTTGAG
206161  AAGCCACTGG  TACCAATGGA  CACTGTGGAC  AATGGTCATT  TCTCCAAGGA  CGCTGTGAGT
206221  ATTAACTGTG  ATGCTGTGAT  TAGTCAGACT  GGGATTGGCT  GTGGAATGAA  ATACTGATCA
206281  GAACTGACAA  GATTTGTGTT  TGGGACTGTG  GCTAACGAGT  CTTTTCAGAC  TTCTATATGA
206341  ATTTGAAATG  GTCTCTCAGG  AAAAGGAGAA  CATGGCCGGG  CCTGGTGGCT  CACGCCTGTA
206401  ATCCCAGCAC  TTTGGCAGGC  TGAGGCGGGC  AGATCACTTG  AGGTCAGGAG  TTTGAGACCA
206461  GCCTGGCCAA  CATGGTGAAA  CCCTGTCTCC  ACTAAAAATA  CAAAAATTAG  CAGGGCGTAG
206521  CGGCGCGTGC  ACCTATGCGC  ATGCATAGTC  CGCGTGCCAG  CTATTCAGAA  GGCTGAGGCA
206581  GGAGAATTGC  TTGAACCCAG  GATGTAGAGG  TTGCAGTAGT  TGAGATCATA  CCACTGCACT
206641  CCAGCCTAGG  TGACAGAGTA  AGACTCTGTC  TCAAAAAAAT  AATAATAATA  AAAGAAAAGG
206701  AGAACATGAC  CAAAGTTATG  AATAAGACTG  AAGGCAAGAA  AATTGTACGC  TTGTAGAGAT
206761  CACCTAGCTT  GTTGCCCTCA  TTGTACAGCT  AAGAAAAGGC  ACCCAGGGAC  ATTGTGGTCA
206821  GCACCAATTT  CTCAGAAAGA  TAGGCAGATG  ATGAGAGGGC  CCTCAGTTTT  CTAACACTG
206881  AAGGAATTGC  TTCTATGTTT  TCTGGTGAAC  TCCTCCCCAC  TCATCTTGAG  GATTCCAGGC
206941  CAGAAGAATC  CACTTTAAAA  AAGAAACATT  TAAAACCAAT  TTAACAACCA  ATCAAAGGCA
207001  CTTTTATAGA  AATACATTTC  ATTTGCTGTT  GGCCTGTATT  TATGGATCTG  AGAGGGCTAG
207061  ACTGCCAATA  TTGTGACTGT  TTATTATTAT  TGCTGTTGCT  AGTATCTAGA  ATATTATACA
207121  ACATATAACA  CTTTGCAATT  TACGAGGCAT  GTCTCATACT  TTTGTTTTCA  CTCCAAACTG
207181  CCCAGTGAAG  TAACATTATC  CCAATTCTTC  CTATGAAACA  GTGAAAGCCC  TAAGAGTTTT
```

Figure 2 (Page 64 of 74)

```
207241 TGAAACTTTA CCTGGTTTAC TCAATTTGGG AATGGCAGAG CAGAATTCAG TCCTTGAATA
207301 TCCTCCCACT GCAGGTTCAT GCTCTTTGAT CTAGGTGTAA CATTTACTCT GAGTAAACTA
207361 GGACTCTGGG CTAACAGAGA TGAAGCAAGA CAGGCTGGAT ATTAGGAGAA TCTAAGAGCA
207421 ATCTAACGAC CATTATAATA AAATCATGAG TTCTAGACTT AAAAAAAGGG AAAAACCTGT
207481 TTTTTTGCTT ATGCGTATAC CATAATATTT ACATTATTTA TTTTTTTCTC AAATTCAACC
207541 TATACGGTGT CAAGTAATTT TTTTTAATAT AACATTTTCC TTTAACTTAA TTTCAATTCA
207601 TTTTTCTGTG TCTACTTACA ACTTTGGCAC TAGAATTCAC AATTTTTTTT TAGAGGTATA
207661 TCTCCTTAAA GGGAAGGGTT CTGACACTGT TACATGTTCT CAATTGTTTG CAAATAGGTT
207721 AATAATTATT CCAGTGTCTC TAAGTACATA TCAACCATGC CAGTGTTCAG CCTCCATAAT
207781 TTTATTAGCT TCTGTGCTTA TTTTGGAAAA ACATTTCCCA TTACCATGAA AGACCTCAGT
207841 TTAGGATGGT TTGGTATGTT AGCCTGATTT CTGCATTCGT CTCATGCAAA GGAAAATAGG
207901 AAACGAAGAA CTGAAATTAC CTATTGATAC AAAATCAAAG TAGCATTTGA AACCATAAAA
207961 CTTAAGTAGG GCTTTTCATC CTTTCTCGTT AGACAGCAAC AGAGAATGGG AAGAAAAACT
208021 AAAGTGATGG GTTTGTGATA CAATTCCAGT AACATAAAGA GCAAGGAGAA GTAGTTTTGT
208081 TGTGTTTATG TTTAATATTC AAAGCTCAAC CTAAAAGTAT TTTTCATTAT CAAACTTCCT
208141 TCTAGAATAA ATGATTAAAA CTTGATTTAA AATATACAAA TTCTCCTTTA TAATACCTCA
208201 AAATGGAGCT ACCCCATTGA GTTTTAAGCT TGTGATTAAA ATATTACGAA AACAAAGGGG
208261 AAGTTGTAAT AGGTAGAACA AGCAGTAGTC TAGGCATTAG GGGATCTGGT GCTGGCTCTG
208321 TGCATCATGT GGTTTCAGGC AACTTTTCAA ATTTTCTACG CAAATTTTCT TATCAATAAA
208381 ATAAACAGTT GGGCCAGAGG ATCTCTGAGT CTCTTTCAGC TTTCAGTGTT TATAAGATTG
208441 GAGAAGTTGG TGGAAAGCT TTAAGTGGAG TGTAAGTAAT TGCAGCTGCA TGTACAGTTA
208501 AAGAGTTGCC TTCAGCCAAG CCACGGGATC TTGCATAAAA AGTGAAATCA AATAGAAAAT
208561 GGTCCAAACT CTGGGTTTGA CCACAGATGA CTTCAGCTAG GATCTGAGTG TAGAGCAATG
208621 AGCTGAACTC CTGATATCCA GATGTTAGCA AGACTTGGAG GCCTTCTAAG GCAGAGCAAC
208681 AACCAGTATC TGTCCTGGTG CTGACCTGAT CTTACTAGCA ATTGGGCCTC CATTTGGGTC
208741 CATTGTACAA AACAACAACA ACAACAACAA TAAAATCTCC AAACACCCAA AATTCAAAAT
208801 TTAGATGGAG AGATACTATT CCCAGAATTC TAGAGATATT TGGAAAGCAG AAAACTATAC
208861 TTGCCATGCT GATGAAGTCC AATTATTGCT CTTTTAAATA CATTTAGCTA CTTCTGAATA
208921 TAAAATGAGT ATCTACTAAT TATTTACAAA ATCACTTGGT AAATATAGAA AGTCACAAAG
208981 AATGAAGTGA TCATCCTGTT TTGTAACCCA GAAATAGTCA TTACTGGCAC TTGTGTGAAT
209041 CAGTTTCTAT TCCTGTATGT GGATGTGCAC AGCGTATCCT GCTTTGTACA CTAGAGTACT
209101 AGCATTTTTC TAATGTAATT CAATATTGTC GAAACATTT TAAAATAGCT TCCATCACAA
209161 TAATCTATCA AATTGACTTG CCAGACTCTC ATTATTAGGT TAATTTATCT CTAACATTAT
209221 GCAGTCATGA GTAATACTAC AAAGGATATT TTTGGACACA ATTTTTCATC TATGCCTTTC
209281 TTTATAATCC TTCATCCTAA GGTCACAGAT TATGAATATC TTTAAAGTAC GGACAAGTCT
209341 TTTAAATTTT GTGTGCAAAA ACAGTGCAAA GCCTTGAATG ATAAAATAGA GGTTTGATAT
209401 ATGTGTTTTT TTGTTTGTTT GTTTTGAGAC GGATTCCTGC TCTGTCCCCC AAGCTGTAGT
209461 GCAGTGGCAC GATCTTGGCT CACTGCAACC TTTGCCTCTT GGGTTCAAGC AATTATCCTG
209521 CCTCAGCCTC CTTAGTAGCA GGGTCTACAG GCATGTGCCA CCACACCCGG CTGTTTTGT
209581 ATTTTTAGTA GAGATGGGGT TTCACCATGT TGGCCAGGAT GATCTCGAAC ACCTGACCTC
209641 AAGTGATCCA CCCACCTCAG TATCCCAAAG TGCTGGGATT ACAGGTGTGA GCCACTGCAC
209701 CCGGCCGATA CATGTGTTTT TAAAGTCACA GAAATTTCAG ATGTCTTGAA GGATTTTAAG
209761 CAATTTAAAA AATAAAGTCA TAGAAGCTTC AATTTAGGAA TGAATGGAAA ATTGATGATA
209821 TTCTTAGGAT ATGGATTTTT CCTAAAAGAA ACAAATGTAT GCATCCCCAA AGATAATTTG
209881 ATTAGTATAC AAATATTAAA TTAAACATGT CCATATTTAG AGCCATGAAT TCTCTTTGCC
209941 TGTCACAATA GCTGGATTTA TTCACAATTG TAGTAATTAG TCCCTGTTCA TTATAATTTT
210001 CTAGGTGATA TGAAGACTTT GTCAGTCCAA GCAAGTGTCC ACATTGTGTG TAGCAAACAT
210061 GAGAATAAAC ATTTTAAACT TTTAAATGTA ATACATATTA GTGTTATGTA ATGTCATCCT
210121 TCATGTTCGA AGGCACATGG AACATTGTTC TGGTGGTACA GAGGGGAGAG AAACACCATC
210181 AGAATGAAAG GAAAGACCGC TCTGGAACCT TCCTCCTTAG CTCTTGAGCT TAGTTTAATT
210241 GTCCTGTCTT ATGGTCTGCT ACAAGCAATA CCACTCTTCA CCTTCGCATG CTTCTCTGTG
210301 GTTGATAAA GTACATGCAA TTTTTCATTT AATTCTTCCA GCTGCACTAA GAAAGGAGCC
210361 TTATCTTTAT TGAACAGATG AGGAAATGAA TGATTAGAGA ATTTAAATGA CTAGCTCTAG
210421 GTCACACAGC TGGAACTTAC AGCCAGATTT CCTTTTAACA ATCCTGTAAC CAAAAGCATA
```

```
210481 CCAGTAGTGC CCCATAAAAT GTAAGTTATA GAGCTGTGTT GGGTCAAAAC TTTTACTGAT
210541 GCTAAGAGGA GGCAACATTA ACAAGGGGAA ATTATTTGTG TATTATGTTT TGGATTATGT
210601 TCTCTCCATA GATAAAAGAC TGTCGTAGTA AAAGAGATTC AGGGCACAGG GAAACTCCAC
210661 CACAAAGCGT GGTACCATTT CCCACAGAAG CTAAATGGAC GGGAAGCCTG CCACCAGGAA
210721 AGGTAAAGCC ACTGCTCTTG TTTGCAGGCT ATGTTAATAA GCTGAAGCTT ATTCCGACAC
210781 ATTTACACAT CTCTGCATCA CACTGACCCT TCGTAAAGAT ACTCCCAGTG TAACATTGGA
210841 GCCAGCTCCA GCCCCTGATC CTGTTGCTTT TTCCTTAGCC CCATGAAATC ATCTGCGAGA
210901 AATTAAGCCA AATAAGCAAT AAATCCTGGG ATCTAGGGAG TGGAATAAGT TTTGGGAAAG
210961 TCTTTTTTTT TTTTTTTTTG ACTGAGTCTT GCTCTGTCTC ACAGGCTGGA GTGCAGTGGT
211021 GCGATCTCGG CTCACTGCAA CCTCTGCCTC CCGGGTTCAA GTGATTCTCC TGCCTCAGCC
211081 TCCCGAGTAG CTTGGACTAC AGGCACACAC CACCATGCCC AGCTGAATTT TTGTATTTTT
211141 AGTAGAGATG GAGTTTCGCC GTGTTAGCCA GGATGGTCTC GATCTCCTGA CCTCGTGATC
211201 CACCGGCCTC GGCCTCCCAA AGTGCTGGGA TTACAGGCAT GGGCCACCAC GCCTGGCCCG
211261 GGAAAGTCAT TTTAAACCAA CCTATGTATG AATCCCTACT ATAATATTCT CACCAAGCGG
211321 CTGGCTCTTT CTCCTGAGCT TGGAAACCTC CAGTAAAATG GAAATAATTA TTTCCCAGAC
211381 CACCACTCTT ATCTGTGAGC TTTTTTGGCC ATTAAAAATT ATTTCTTCCA TTATATTTTT
211441 ATCTGTGTCT TCACAGGTTT TCTCTTTCTT TCACTTTAGT GCTTTTCTTC AAATAAGCAG
211501 GAAAAATCCA ATCTATCATG CACATGGAA CCCTTTCAAT ATTGGTCTGT GGTTGTTCCA
211561 TTTTATGGGG ATGCTTTTAA AGAAAAAATT TGTCCTTTCA ATATATTGAA TATCTTCCAG
211621 CACCACATCA CCTGCAAGCT TTGTAAAAAT AGTTCTACAT ATTAATTTTT TTTTTTTTG
211681 AGATTGAGTC TCATTCTGTC ACCCAGGCTG GAGTACAGTG ACATGATCTT GGCTCATTGC
211741 AACCTCTGCC TCCTGGGTTC AAGTGATTCT CCTGACTCAG CCTCCCGAGT AGCTGGGATT
211801 ACAGGCATGC ATCACCATGC CTGGGTAATT TTTGTATTTT TAGTAGAGAT GGGGTTTCAC
211861 CATGTTGACC AGGCTGGTCT CAAACTCCTG ACCTCAAGTG ATCCACCTGC CTTAGCCTCC
211921 CAAAATGCTG GGACTACAGG CGTGAGCCAC TGCACCCAC GTAGTTTTTT TTTTTTTTA
211981 AGTTGAACAT ATGTGAAGGC AGGACCTAGT GACACATAGC AATAACATTT CCAAGTAGAC
212041 ATTACACTAG GGAATTAGTC AAAGTGCTCA TTTAAAGTAC CATCTCTCAA ATGTATTAAA
212101 AGAGAATCCT TGGATGTGCA ATACCTTAAT TCAAAGGCAG CTCGTTATGT ATAAACTCTC
212161 AAGCTTTGTG ATAAACAAAT GTGCATAACA GATGGGACTA TTGACTTACA GCCCAGGGAA
212221 TTTTATTGAC GCTGAGAAGG TTATGTGACT GGCTCTGCCA CTGTCATCCC CATTCACTTC
212281 ATTTTGGAGC AATATGACAT AAATGCCTTA CATGTGGGTT TTCTCTATTT ATCATGTGTT
212341 TCCTATCCCC TTGAAAGATG GCCATATTTG CTTTACTTGG TTATAAGATC CCATATTCGC
212401 TGTCTTGAAG CCAACCAAAT AATTTGACAA AGTGGGTTTG TAGTGCTGGC TATTTTGGTG
212461 AAAAAAAGAC AATGAGACTT CATGTGTCAT CCAAAGTTCT ATCAGATCGA GCTGTGAGAG
212521 AAAGGAAAAG AAAGGGGTCT CAGTCAGGAT GCTCACTGCA TACATCTGTG TTGTTGTCTA
212581 GGTCCAGATT TCTGTTCATT ACGCTATGGG CTGGCTCTTA TCATGCACTT CTCAAACTTC
212641 ACCATGATAA CGCAGCGTGT GAGTCTGAGC ATTGCGATCA TCGCCATGGT GAACACCACT
212701 CAGCAGCAAG GTCTATCTAA TGCCTCCACT GAGGGGCCTG TTGCAGATGC CTTCAATAAC
212761 TCCAGCATAT CCATCAAGGA ATTTGATACA AAGGTAAGTA TGATGGAAAA TAGGGCTCTT
212821 TGTTGAGAGA AAAAACTTTG AAAGGAAGGC ATAGATCTTG ATTCTGTGGA GTATGGAAGT
212881 ATACATTTCC AATGACAAAT TAAAACTGAC TGGAACTATT TTTCTTTGAG ACATTGCTTA
212941 CTTCAATAAT AAAAATAAGA TTTCATTGAG GTTATTATGA TTATAAGGTG GGGGAACTGT
213001 AGAGTTAAAT GTGAAAAATT TAAAAATGGA ACAGTTTATG TGATGTCTTC AATGAAAAAC
213061 TAGGTATTAC CTGGGCACAT TCTTATAGGT TACTCAATCC TATTCAGTTC TCTGCCTGTT
213121 TTATTGTTTC TGAGCAATTT TATATCCCTG TAAATTCTAT ATAACCAATA GAAATGCAAA
213181 CGATTCTTGT CCATAGCTTT GCAAATAAAT TTGCCAAGA GAAAAATCAG TTAAAACTTT
213241 TCTCCACTCA CCTCCCAGTT GAATTAGCCA ATTTTGCTGT TTGTTTGTTT GTTTGTTTTT
213301 TGAGATAGAG TCTTCCTCTG TCATTCAGGC TGGAGTGCAG TGGCATGATC TCAGCTCACT
213361 GCAGCCTCCG CCTCCGGGT TCAAGAGATT TTCCTGTCTC AGCCTCCCAA GTAGCTGGGA
213421 GTAAGGGGGC ATGCCACCGC GGCTGGCTAA TTTTTGTATT TTTAGTAGAG ACAGGGTTTC
213481 ACTAGGCTGG TCTCGAACTC CTGACCTCAG GTGATCCACC CGCCTCGGCC TCCCAAAGTG
213541 TTGGGATTAC AGGTGTGAGC CACTGTGCCA GGCTCTGCTG TATATTTAAA GTCTATTTCA
213601 GCATTGCTTC CTGCTTGTGT TATGCGTGAT TCTTTGAGTT TTCCTTTGAA CCAGTTATAA
213661 CATCTTACTT ACTTCCTCCA TTAATCAATG AGTTAAATAA AATCTTTGTT GTATGTTTAT
```

```
213721 TTTACATTTA TATGAAAACC ATGAATTTAC CCAATTAAAA AAATTATCCT TTAAATTATC
213781 TTGTACTGTA CATTTCCCAT GTCATCCCTA TAATTCATGA TTAATGATTT TATTACATTG
213841 GACCTAGCTT ATTTACAATG AGTACATAAA TTTATTGTCT CCAGTCTTTC CTCCATTATC
213901 CCGTCTACAT ATCCACACTG AGTAGATTCA CTACTCAGGA ATCTTGGACA CCTTCAAGTT
213961 GCCAAACATG CAGTGTTCAC TGGACATGCT GTGTTCCTTC AGAATTTGGG CCTGCTTCTC
214021 AGCACACTCA CATCTGCTAT CAATGACCCA TGGAAAGTTT TTGCCCTGAG CAAGCCAGAG
214081 TCCCTGTTAG TTTCTTCCAA ATGCTACAAG TTCACTTTTG CTATTTTTTC CGATGAGATA
214141 AAATTTTCCT TTTTGACTTT CTACAAATCA TAGTCATTTT TCAAGGGATA GTTCAAGTAT
214201 TGCTTCCTTT CTGGGACCTT CCCAAATTAT TATTTCTCC TCTCAAAGTC TCTGTTTTAT
214261 TTATGTTCAT CCTCAAATCT TGATTCTCAC ATGAATCATA TACCTTGTAT TATTTATAGT
214321 TTTTTTGAGT AGGTAAAATA TTTCATATTT TATATTCTTT GGCTCTCTAC TTTATAGCAT
214381 GATGCCAGAT ATTTAGGGGC CTTACTGCAT TTATTTTTA TTTTATTTTA AAATCTATTT
214441 TATTTTTTAT TTATTTATTT TAAAATCTAT TTATTTTTAG GTAAATATTC AGGTAATATA
214501 ATTTATGTAA TTATTTAGGA ATTTTAGGTA GTTATTTTAA AATAATTCAA ATTATTTATT
214561 GAGTTATATC AGAAGAATGT GATCTTATTC ATTTGTAATA TGTGTTTTAG GAACTCAGTT
214621 CAGCCAGGGC AGACCATAAT TCCCAAACTT GACTTTTCTT TTTAATTAGG CACTGATTTT
214681 GGTTAAGAGT TCAGTAAAGT TTTGTGTGTG TGTTTTAAAA AATTCTTTGA TATAAGAGTC
214741 AAGATGTTAC TCAACTTTTA CTAGAAGCAA AATAGAGGAA GTGCTTTCAC AGATGAAATA
214801 TCTCTCAATG TTTTCTTCCA TTTACTTCTT CCTATTATTC ATCTATATAA TCATTTTCTT
214861 TACCTCTTTT CTTCATTTCT TCTGTTTTTC TCTCCTACTA AGACAAGCAA ATTAGGGGTA
214921 TAATTGGTTA TTTGGGAAGG TAGGAAGAAT ACAGAGAGAA ACAAAAATCA ATATTTTATA
214981 CTAGGGTCTC ACTAACCTCA AGCAACTCTG ACTGTAAAGT AGATTTTCAT AATAGGACTT
215041 CTTGACAAAG AGTTTTCCTA TTTTTCCCCC AGGCCTCTGT GTATCAATGG AGCCCAGAAA
215101 CTCAGGGTAT CATCTTTAGC TCCATCAACT ATGGGATAAT ACTGACTCTG ATCCCAAGTG
215161 GATATTTAGC AGGGATATTT GGAGCAAAAA AAATGCTTGG TGCTGGTTTG CTGATCTCTT
215221 CCCTTCTCAC CCTCTTTACA CCACTGGCTG CTGACTTCGG AGTGATTTTG GTCATCATGG
215281 TTCGGACAGT CCAGGGCATG GCCCAGGTAT CCAGATACTT TCTCATTCTT GGTGGGATCC
215341 AGATTTCTGA ATTCTACAAA ATATCAAAGG TCTTAATGAT TTTCATTTCA GGGAATGGCA
215401 TGGACAGGTC AGTTACTAT TTGGGCAAAG TGGGCTCCTC CACTTGAACG AAGCAAGCTC
215461 ACCACCATTG CAGGATCAGG TAAGTGTGCA CAGATGGGTC ATAGCTTTGT CATCTGTTCC
215521 ATCCCACTGT GTCTTATCTT CTATGAATCA AATGGTTTGG GGAAGAGAGA GAAAAAGTAC
215581 TGCTGAAAAA TTCAACAATA TAAGCACTT GCATCACAAA TAGGAAAGAT GCATCTGTGC
215641 AGTAAAGACA TTGAAGCTTA GAAGTAGAAA AAACCATTGT GAGCTAGGTT TCAGCTCAGA
215701 AAAGCCTTAG TAGTCAGAAA AGCCTTAGTA GTCAGAAAAG CCTTGTCGGA AAAAGTTTAA
215761 ACCTTTAAGA ATTGCACACA TGGAAAAAGA TCAAGTAAGC TATATATACA CCATCTTAGC
215821 AATGATTTTG AAGTGAGAAT TAAGGCTACC ACAGCTCCAG GTGGTAAGGA GAGAAATCAG
215881 GCTGGAAGAG TTTGAAGTTT CTGTATTATT CTAAGCTCTT TACTATTCTA TTATGAGCTC
215941 ATTAATTCTC ACAACAACCC TCTCATATAA GTACCATTTT AAATTCTTAT TTTACAGAGA
216001 AGGGAGTTAA GGAAGGTGGA GATTAAGAAA ATTGCCCAAA TACAAATAGC CAGCAGGTGG
216061 TAGGTCTGAG ATTTAAGCCC ATGCAGATTT TAGCCCCAGA GCAGACATTC TCAATCACTA
216121 TGCTAGACTG CCTTTCCATG GTATGTGATC CTACTCAGGC CTCTACAGCT TTATCATTGC
216181 TGTTCTCCCC AGCCTGTCGT GCTGAGAGTA TATACTCGAA GAGCAGAACT AAAATTCCAT
216241 CCAGCTTCTC ACTCCTAGGT CCACTACACA GCTGCATCCT GCAGACTTTT ACCTCAAGCA
216301 ACCCTCCTGC GTTCTTGCTT CCTTCCATCA TAGTTGTAAC CATCTCCTCT ATTTGCAAAT
216361 ACTATCTGCT GATCTCTCTC TTCTAGACTG GTTTCTTTCA ACCTTCTTCC CACCAAAACC
216421 AAGTTAGCTT GCTAAAATAA AGATGGCGCA TTTTTACTCA CCCGCTTGAG AATTTTCAAT
216481 GTGTTCCTTC ATGCTTACAG AGTAAAGCCT GACCTCTTTA TTGCATGAAT ACAAAAGTTC
216541 TTAGCCATCT GGCCCCAACC TTGTTCCACT CAACTCCCCT GTGCAAGCAT GGCTCCAGTG
216601 GCACTGGACA TTGGCTGCTC TCCACATAGA TCTGCACTGC ACTTCCCTCT GGCTCTGCTC
216661 CCGTTAGTTT ATATGCCTGG AAAGTTCTTT GCCCCTGTTC CTTGTGCCAA AATTCCATCT
216721 ATCCTATTGC ATAGCTTATG TAAAAACTTC CTAAACCTTT TTTTTTTTTT TTTTTTTTTT
216781 TTTTTTTTTT TTTTTTGAGA CGGTGTCTCA CTCTTCCGCC CAGGCCGGAC TGCAGTAGCG
216841 CTATCTCGGC TCACTGCAAG CTCCGCCTCC CGGGTTCACG CCATTTTCCT GCCTCAGCCT
216901 CCCGAGTAGC TGGGACTACA GGCGCCTGCC ACCATGACCG GCTAATTTTT TGTATTTTA
```

```
216961 GTAGAGACGG GGTTTCAAGC CAGGATGGTC TCAATCTCCT GACCTCGTGA TCCGCCCGCC
217021 TCGGCCTCCC AAAGTGCTGG GATTACAGGC GTGAGCCACC GTGCCCGGCC AAAACTTCCT
217081 AAATCTTATA ATTATTATCA ATTTATCCTC AGATATACTT CCACGTACAT TGTAGTTTTA
217141 TTATATTTAT ATTTTACATC TTTTTTTTCA AATTGCAGTT TGGGACCCAT TAGTGAGTCA
217201 TAAAATCCAT TGAGCGGGTT AAAATCATTA TTTTAAAAAA TGAGTAGAAT AGAATAGAAA
217261 TTGTTGGAGT GCATTGGACA TGGTAAAGTT AAATATCGAT TCATGAAACC ATCGTTTGAG
217321 GCATATGTGT GTGGTTGTAT GTACAAGTGT TTATGCATAT TGGTGTGTGT GTTATGTTAC
217381 CCTGTAAAAT GCATTTCTTA CTATAGGTCT CTGTGAAATA TGTGTCTTGT TGTTTTTTAA
217441 TGTAGACTTC CAAAGCCTAC ATGGCATTTC ACTAGTGACA ATCAATTTTA TTCACATTTT
217501 TCTCTCCAAT TGGACCAGAA GCTCTTTGAG GGCAGGGGCT GTATCTTACC GATTTTTGTA
217561 AGTCTTTCAT TTCCTGCCCC TAGCCTCATA TTAGATCATG CAAGAATGCA ACTGTAATCA
217621 CAAGAAAATG CTAATGGGCT GTGATAGCAG AGAGTTACTG TGACAAACTA AGGGATTTAG
217681 ATTTGGTCAC ATTGGTGTTG AGGAGCCATT GAAGAATCAG AGAGTGTGTT ACTATTATTT
217741 GTTAATTTTA ATTATATCAT ATTACTTTAC TGGGGAAAAT CTGTGAGCTA TTTTAGAAAT
217801 AAATACTCTC ATTGCCCAAT AATTCTAAGT CTGCCACCTC ACTGTTGGGA CATTGTTTAG
217861 GGAGGCCACG AAGTCTCAGC CTTTGATATT TTCATAAGTG TTTTTCTCCC TTTTTCCTTT
217921 AGGGTCAGCA TTTGGATCCT TCATCATCCT CTGTGTGGGG GGACTAATCT CACAGGCCTT
217981 GAGCTGGCCT TTTATCTTCT ACATCTTTGG TGAGTCACTT TCTCTTAAAT CCTAATGCCT
218041 CCATTTCCTG AGCATCCATT TTGGCACCTA CACCACCCAC ATTCTTCCTA TATGAAAGAA
218101 AATGTCCTTT ATCAAATGGA AGATGATAAA AAATGTCAAC GGTTGGTATC ATTTTAATC
218161 TAGTCACACA ACCTGATTAA CACCTTCCTG GTGGTTCTGG GAAGCCACAC GCAAAAGGTA
218221 GAGGAGTTGA CTATTCACAT GGCACCCACC GACTTGTGAT GCAGTCTTGT CCTTCCATAT
218281 CAAGCACCTT CTGCAGAATC TCTACCACCA CATCTGAAGT GCCTGCTATA TGCAGTTAAG
218341 ATGTCAAAGA TAGTGAAGTA CATTTTCAAT GTGTCTTCAT ATTTCATTAT AATTATTATT
218401 TCTGTCCAAG ATGCCTTTCA CCTGTTCTCT ACCAAGTTAA TCTTGCAAAG TTCAATTCAA
218461 ATGTTCCCTT CCCCATGGGC CCTTCCAGGG CTTACCCTGT CAGATTCTGG CATTCTCTCC
218521 TTTATGATAT TTCCTCTCTA GGTTATGTTG GTGTGTAATT ATTTATTTCT CCTTTTCTTT
218581 CCACTAGACT GTGAAATGCT TGAGGCAAGG AATCCATTCT ATGTTTCAT CACTTGGGTG
218641 TCATCATGGT GCCTGATTTT TAGCTTTAAA ATAAAGAAT CAGTGAATCC AGTAATTAGA
218701 GGGGATTTAA AGAAAACTAG TCCTCAGAAT CTTTTAACAT AGAATGTTCT TCAAATAAGG
218761 AATTCCAATA ATAAGACAAT TTTCTACACT TGATTTTGTT TTTATAGCCA AATGGTGTCA
218821 TTAAATATAG TCCTGGCCTG AATGGCTTTC TCATTAATGA TGCTAATTAT TTTGGTTTGT
218881 ACATGTTAAC CAGGTATTGT ACAAAAATAT TTCTTTTGGG AATCCATAAT GGATGTATGG
218941 CTTGAATACA ATAATACTG TCTCTTGTAA GTGCATTGGA AATTTTTCCC TGCCACATGA
219001 TTTCATGGAA GGTTGTTTCG TGTATGTATG ACTGCAAACC TGACTATTCA GATCTTCCGC
219061 AACAAGACAA CTTATGTGTG CATTAAGAAG TTGCTGCCTA AAATACATAA CACTGTAATC
219121 ATTGGAGACT TTAAAGTAAT TAATCAGCTA TGCAATGCCA CGCTCCTGTT ATCTCCAGAG
219181 GGCTCTGACA TTGACAAATG GTGGCTTTCT ATTTGAGACG TAATATCTAA AAAGCTTTAA
219241 CAGGTTTGTA GAAGGATTGA AGAAAGAAT GGGAACATTT AGGTCCTTAT GGTAGAATAA
219301 GCATTAATTG ATTAGTGTGT AGAAGGGAGA GGCATGCCAC TTCAGAGGAA ACTTCCTTCC
219361 CCCAGTAAAC AAATCTACCT AAAAACTAAT TTTATCCCTT CTTCCCAGGT AGCACTGGCT
219421 GTGTCTGCTG TCTCCTATGG TTCACAGTGA TTTATGATGA CCCCATGCAT CACCCGTGCA
219481 TAAGTGTTAG GGAAAAGGAG CACATCCTGT CCTCACTGGC TCAACAGGTA CAGTGCACAC
219541 CTTGTACCTG TGGCCCATGC AGAGGTCTCT AGGGCAGGGT GTGGATCTCC TCTGAGAGGC
219601 ACCATCTTGG CTGCTCTAAT ACTCATGCTG ATTAGATCTT TCTTTTCAGC CCAGTTCTCC
219661 TGGACGAGCT GTCCCCATAA AGGCGATGGT CACATGCCTA CCACTTTGGG CCATTTTCCT
219721 GGGTTTTTTC AGCCATTTCT GGTTATGCAC CATCATCCTA ACATACCTAC CAACGTATAT
219781 CAGTACTCTG CTCCATGTTA ACATCAGAGA TGTGAGTTTA CTTCCTATAC TTCTACGAAA
219841 ATGATAATGG TAATAAGGAG AAACAGTTCT GTGTTACCTA TTCATTCTG GCTTTACATA
219901 TAACCATTAA TTTAACCTTC ACAATGACCT TGAGAGAGGC ATTGTTATAA TTCCCTTTTC
219961 ACAGATGTGG AAACAGGACA CTTAGAGGTG AGATAACTTG CCCCAGGTTG CACAATACTA
220021 AGTGATAGAG CTGCTGCAGC ATCCATATTC TTAACCACTA TGCTATACTA CCACACCAGC
220081 TGATTCCAAA GCTTCTTTTA GAAATAATAT TGCTGGGCCA GGCATGGTGG CTCATGCCTG
220141 TAATTCCAGC ACTTTGGGAG GCCGAGGCAG GCAGATCATG AGGTCAGGAA TGCAAGACCA
```

Figure 2 (Page 68 of 74)

```
220201 GCCTGACCAA TATGGTTTAC TAAATATCAT CTACTAAAAA TACAAAAATT AGCCAGGTGT
220261 GGTGGCAGGC ACCTGTAATC CCAGCTATTC AGGAGGCTGA GACAGGAGAA TCGCTTGAAC
220321 CCAGGAGGTG GAGGTTGCAT TGAGCCAAGA TCATGCCACT GCACTCCAGC CTGGGCGACA
220381 GAGTAAGACT CCGTTTCAAA AACAAAAAC CAAGAAATT AATATTGCTT TTATCTGGAG
220441 CCCAGAGTGA TGCAGCTTCT GGCCCTCTTA TCTGAGACAG TGTTCTTTTA GTGTGAAAAA
220501 GGATGCTAAT TTTCCCCCAA ACAACCCACA GTATCATGGG GGTAAGTTAA TGGCTGGTCT
220561 GTGTAACTGA CAAATTTTGG TGCTAACGTA TCTCTATAAC TACTCTGTAT AAACTTCCTT
220621 CCTTCAGAGT GGAGTTCTGT CCTCCCTGCC TTTTATTGCT GCTGCAAGCT GTACAATTTT
220681 AGGAGGTCAG CTGGCAGATT TCCTTTTGTC CAGGAATCTT CTCAGATTGA TCACTGTGCG
220741 AAAGCTCTTT TCATCTCTTG GTAAGGATAA GCGTGTGGGC CCATTTAACC AATCCCTTTT
220801 CTGCACATGG TCTCAGAGGG TTCCCTGACA GCATGTCCTC ATTGCCCAGG GCTCCTCCTT
220861 CCATCAATAT GTGCTGTGGC CCTGCCCTTT GTGGCCTCCA GTTACGTGAT AACCATTATT
220921 TTGCTGATAC TTATTCCTGG GACCAGTAAC CTATGTGACT CAGGGTTTAT CATCAACACC
220981 TTAGATATCG CCCCCAGGTA AGAGCTCTAC CTGTTTTTTC CCCTCCTCCA GACCCCTCCA
221041 GAGGTGTTAG ACCTCAGTGG TCGCCGTGAA ACTCTTTAAT GTTACTGACA TTGCACTAAT
221101 GGCAGAATGA CAAATAACTA CAAATATCTG TCTGTGGCCA TTTTTAGAAC AACAAATGTG
221161 GCATTTTTAG AACAACAATT TCCAATCTTG GCCAGTAATC ATTTTGACAA AAACCTTCCC
221221 AAGCTTCCCT AACAGAGATT GAACTGTGTA TGCTGGGAAA AGGCCCACAC ACAGGTGATT
221281 TGGAAAAGTT TCCATGGTGT TGTTCATATT AGCTACCACA TATATATATA TATATATATA
221341 TATATATATA TATATATATA TATATATATA TACAGTCACA ATAAGCCAGC TCCTGTGCCA
221401 AGACTTGCCA TATATCAACA CATCTAATCC TCACAGTTAT ATTAGGTAGG CCCTATTGTT
221461 ATCCCCATTT TATAAGGGAG AAGGCTGAGG CACAAGGAGG TTAAATGGTG TGACTATGGT
221521 CACATAAAGG CAGAGCCAGG ATTTGGACTG GGGGAGTCTG GCTTTGGAGT CTGTGTCCTG
221581 CCCGTTGCAC AAACTGGCTT CTACACTGAG CAGCCAGGGT AAAGAAACGT GGTTCCCAGA
221641 GAGACTGCAT TGCTCCCTGG TTATTGACTT GGTAGATTGG TAATTTCAGG TTTGGCAAAT
221701 AGACATTGCC CTGAATGTCT TTAGGTGAAT GAAAACTGC ATTAAGCAAA ATGACTTTGC
221761 CATTAGAGCT GAATTGCATT AAAGTTGAGT TGCTGCAGAA GCTGTAGGTG GCTTTCTATA
221821 TAAAATCATT TATAAAATCA TCTTCCCATA GATATGCAAG TTTCCTCATG GAATCTCAA
221881 GGGGATTTGG GCTCATCGCA GGAATCATCT CTTCCACTGC CACTGGATTC CTCATCAGTC
221941 AGGTTGGGTC AGTTTATTGA ACATCTTCAA GTGGCAGGTA TTGTTTTAGG TGTTGGAGAT
222001 ACACACGGTG CTCTAAAGAT CTGGATGGCA ACACAATTAC TCTATTTACA TGAGCCTCTA
222061 AATCAGACTC TGGTAGGTCA GATTTCCCAG AGGAAGAAAA ATATAAGCTT ATTTTCTCAA
222121 GATGAATAGA TGTTAGATTG ATTAAAATGA GCTGTTCCGG TGCAGAAGAC AGCACGTATG
222181 ACTTCCTAGA GGTACATGAG CATGAAACAG TTCTTAGTTA TGACCAGAAT GAAAGACACA
222241 TGTCAAGGAA TAGCAAGAGA CGAAGACAGA GGGGCAAAAG AAGATCATGA AGAATATGTT
222301 CAGACTAATC CAATTTTTAA AAAATCACAA AAGGGAAACA AAGTGTCCTA GGCCAGTTTA
222361 AAGATAATTT AATGTCTGGA AACAGATCGG CTGTGAGACA TTGCAAGGAG GCTTGCTCGG
222421 TGTTTGAAA TGCAGGCTCA TGAGGAAGAT GAAAAGACAG ACCCAGGCAG GGATGGAAGG
222481 ACTGACTAGA ACCAACTTAC AAAGAGAAGT TTTGTTTTA CTACATTTCT ATGTGATCAA
222541 GTTCCCAGGT TAATATTTGA CTAAACTGCT AGGAATCCAC TGTGACTATA ATGCTGGAAA
222601 TGACTTAGTA GGGCTTTCTG AGGAGGGTCA CACAGAAGAC CAAAGAGAAC TCATGTTGAA
222661 TTGAGATGGG TTATAGTGAT AGTTGTCAAC AGCCAATACA GAAACAAAAA AAAACAAAAC
222721 AAACAGCAAC AACAACAACA ACAAAAAAAA AAAACAGAGA AGACACAAAC ACAATGCCAC
222781 AATGCCATTT TAGGCATAAT TTTAAATGAG TAATATTATA TGTTGAAATC CAAATTTTCA
222841 GAAAACATT AGTGTATTTT ATTTTGTTT AAAGAAATAA CCATCTCAAC TCAGAACCCC
222901 ATGTGCATTT TGGCCATTTT GTTTCCAATA GTTTCATAAA CTTTCTTAAG TAACTACTGC
222961 ACATTGTTCC TTATATTCCT TGTGATCAAC ATTGCAATAC ACAACTGGGA GGGCTACTAG
223021 AACTGGTGTA GAAGGAACTT GTGAGATTGA TCATTTCTC TGTTTTTAC ATCTAGGATT
223081 TTGAGTCTGG TTGGAGGAAT GTCTTTTTCC TGTCTGCTGC AGTCAACATG TTTGGCCTGG
223141 TCTTTTACCT CACGTTTGGA CAAGCAGAAC TTCAAGACTG GCCAAAGAG AGGACCCTTA
223201 CCCGCCTCTG AGGACATAAA GTTACAAACT TAAATGTGGT ACTGAGCATG AACTTTTTAA
223261 ACATTTTTTA CTTCTCTCCA TATTCCTGAC CATAGACTCA GCAGTTCTTA ACTCTGGCTG
223321 TGTGTTAGTC TTCCCTGGGG AGCCTTTATA AGACACTGAT ACTTGGGACC CACTCCAGAG
223381 ATTCTGAATG AATTGGTCTG GGGTGGAACC CAGATACTAC TAATTTTTAG ATACTCCTTA
```

```
223441 GAGGTTTCTA GCATGCGCCC GGGGTTGACA ACAGCTGGAC AAACTTGAAA AGTCAATTCA
223501 TGTGGCCTTT GAATTTTCCT CATTGGAAAG TACTAAATAA ATAAAAATTC ATGTGAAAAT
223561 GATCACTGAT AAATATCTTC ATGGTGGGGC AGGTTATTGG ATGCAGAGAA GATCTGCTCG
223621 GAATTGTAGC CATATGTTAC AGATCTCAGC ACCGATCAGA ACTGTAAAGC TATAATCCCC
223681 AGAATTAAAG TTTTTATTAT TTTTTATACA TTGTAAAACA TAGACGTTTA TTTATGTGAT
223741 TAAATTCTAT TAAAATTTAC ATGCTAAAAT AAAATAGACC ATTTTCAAAT TATTTAGATC
223801 CAGATATTTC CATCAGATTA AACAGATATT TATTTATCCT AGCCCAATTG CAAGAGATTA
223861 ATGATGAGAA AATGACCAAT ACAAGATTAA ATAAATGAGG TTAACTTAGA AATCAAGGAC
223921 AGAGAAGATA GAACTGGAAA GCTTGTATTG TGAGAAGAAT GAATGTGAAG GAAGGCAATG
223981 TAGACACTTC CAGAAGGGAT AGCAATATAG TTTAGACCAT ATAATGAAAA TTGGAGAGAG
224041 ATGACAGAGA CACTTTCAAG TGAAATGACA ATTTATATGG GGGAGAAAAA TATTGAAGAC
224101 ATAACAAGAT GAGAAAAGGC ATAGAAATGT ATCACATACA AGGCATAGAA GTGTATCACA
224161 TACAAGAGAA GTTCCTTTTG AGCGTAGAAA AAGATAATTT AACCTTCTTC ATATTTTTCT
224221 TACTTTCCCA AGATACTCAG ATAGGCAGCG TCAACTCTAA CAGGAATTAA TTTGGCTCCT
224281 AACACTTAAG ACATATCCTT TAGTTTGTCT CCTCACACAG AACTGATTCT GGTTTTGCCA
224341 CAACATGTCT AGAGAAGAAG TTCCCACCAT ATTTTAAATC CTATTAAAAA ACTGCTTGGA
224401 CAAGAACCTT GGGCTAATTC AGCAGATGAA GAGAATCTCC TAATGCAAAT CAATGGGTAT
224461 TTTTGAGCAA GTTTTTCAGA AAAACAGAGT GTCAGGCCCT GAGGGTGGTA CTAAGATGAG
224521 AACATTGATT TTGCCTTCAT GATATTGACA ACACAAAGAG GAAAGGGGGT TTGCAGAAAA
224581 CTAAAAGAAG AAGTAGAAGA AAAAAGAAAG ACATAGTATA ATAGGTAGTC AAATTATGTA
224641 CAGAAAAAAG AGGAAAAAAA ACCAAAAAAG GGTGGGGGAC AGACAACCCA ACTAAAAAAT
224701 GGGCCAATGA CTTGAACAGG GACTTCATAA AAGAGAAAAT GTAAGTGGCT CCTTAACATA
224761 TAAAAAGATG TTCAACTTCA TTAGTCATTA CAGAAATGAA AATCAAAACT ACAATGAAAT
224821 ACCACTATAA AATTAACTAA TGGATAAAAT GAAAGGAGAT GGAAAACAAA ATGTTGCCAG
224881 ACATGTGGAG CAACTGGAAC TTTCATACGT TACGAATGTG AACTTTGGAA AGCTGCTCGG
224941 CAATATCTCC TAAAGCTAAA TGTACAATTC CAGTGACTCA GACATTTAC TTAGAAATGC
225001 ACATATACAT CCATAAAACA TGTACAACAA TGTTCATAGG AGCACTATCT GTAATAGCCT
225061 GAACAGGAAG TTGTCTGTTA AAAAAAGAAT GAGTAAATAA ACCACGGTCT ATTTGTATAG
225121 CAATGAGAAT TAACAGACCC CAATATATAA TAGATGAATG GGTCTCATAA GCACAATATT
225181 GATTAAAGGA AGACAAAACG CACATTCTTT TAAAGGTTTA TAAAATACTT TTTAAAAACA
225241 GCTACAACCA ATCCGTCCTG TTAAAAATCA GTGAGCGATT TCCCTTGTGC AGGGATGGGG
225301 GTTGTGGCTG GATGGATGGT ACTTAAGAAG TGCTCCTGGG GTACTAGAAA TATTTTATTT
225361 CTTGACTTGG ATGTGTGTTT ACTTTGTGAA TATTGTACAT TTATGATTTG TGCACGTTTA
225421 TGAATGTAGA AAATAAAACA GAAAGCAAAT TCAAAGTATC ATCCTTTTGA GAGCTTCTGC
225481 TCTGACTTCG TTTTGACCAA TGGAGCAGTT GGGAAGGGGT CTTGGTCCTT CGGTCCTTTG
225541 CTTTTTTTTT TTTTTTTTTT TTTTAGACAG AGTCTCACTC TGTCGCCCGG GCTGGAGTGC
225601 AGTGGCTCGA TCTTAGCTCA CTGAAAGCTT TGCCTCCCGG GTTCATGCCA TTCTCCTGCC
225661 TCAGCCTCCC CAGTAGCTGG GACTACAGGC ACCTGCCACC ATGCCCGGCT AATTTTTTGT
225721 ATTTTTTAGT AGAGACGGGG TTTCACCATG TTAGCCAGGA TGGTCTCGAT CTCCTGACCT
225781 CGTGATCCGC CCACCTGAGC CTCCCAAAGT GCTGGGATTA CAGGTGTGAG CCACCGCGCC
225841 CGGCCCCTGG TCCTCTGCTT TCATGTTCTT CTTGGTCCTG TTCCTCCTCC TCTTTTGTTG
225901 GAACTTCCAG TATCAGAGCA GGAAGGAAGG CAATGGGTCA ATCGATGCTG TCAGCTTTTG
225961 GATCAAACTG CAAGTTCTCA AACAGCAAAA TTAATGAGCT CAGGCTTTGA AGAAACCATG
226021 ACCCTGAAAG CATCAGTTGC TTCCAATTGC ATCAGTTGCC ACGGGTGATA AGAACAATGA
226081 TGACTCAGAA TGCCTAGGTT TTCCCAGCAG CTTCTCTGAG GTTTTCCCAG CAGCTTCTCT
226141 GATTGATTCC TGACAGATGA CTTCGGTGTG TCAGACTTTC AGGGTATCTT TCCTTATGTG
226201 ATGGTTTGAG GAAGAGTTAC CATTCACATT CCTAATGGCT TCAGAATAGA TGCAATTGTG
226261 AACTGATAGG AAACATTTCT AATTCATCTC CCCTCCCCAT CCCTAAAGGA TTGTTTCTAA
226321 CAATAGTCAT GAAAATTAAT TCACTTTTCT CAAATAGTTT ATTGTCATCT ACCTAATGAT
226381 GAGATGACTT ACTTTTCTC CTTGACTGTT AAATATTATG AATTATATTA ATGTATTTCT
226441 TAATGTTGAG CTTTCCCTTG AATATTCTTT TGATGTACGA CAGAATTTGA TTCACTAATA
226501 GTTTATTTAG GACTTTGGCT GATGTACTGA TATATGAGAT TGGCTCTGTA TGCATACATG
226561 TGTTTGTGT ATCTTTTTG TGTCTGGATA TGGAGCTTAT GCTGATTTCA AAAACAAGAA
226621 AGGAGAACTT TCCTTTTTCC CCATTACTCT GAAAAAGATT GACTAGAATG GAATTTTTAT
```

```
226681 AATTGCTGTT GTTATTTGAA AGCTTGAAAG CATTGGTTTG TAAAAATCAT GCAGGCTGAA
226741 AGCCATTTTG AGGAGACTTT GATAACTTTC TCAATTTCCT TCAGTTACTG GTCTTTTAAG
226801 GGGTTTTATA TTTTTCTTTG ATCAATTTTG ACCATTTATG TTATCTTGGA GGATCATCTA
226861 TTTTACACAC TATTTAAAGT ATATTTGCAA AAATTCAACT GTTTTATCAG GCTATCTTTT
226921 TAATAATATA TTCATTTTAT CTATATCTGA GGTTTTAGCT TCTTTGTACT TCTGACCCAA
226981 TTGCATGTGT GCTTTCTTTC TCCTTCATTA GACTACTTAG TCATTTACTA ATTTTAAGAA
227041 TAGCTTGTCT TTTATTTATT TACTTATTTA TTTTTGAGAC GGAGTCTCAC TCTGTCACCC
227101 AGGCTGGAGT GCAGTGGCGC GATCTCGGCT CACTGCAACC TCCGCCTCCC GGGTTCAAGT
227161 GATTCTCCTG CCTCAGACTC CCGAGTAGCT GGGATTACAG TCATGCACCA CCATGTCTGG
227221 CTAATTTCTG TATTTTTAAT AGAGATGGGG TTTTGCCATG TTGGCCAAGC TGGTCTCAAA
227281 CTCCTGACCT TAGATGATCT ACCCACCTTG GCCTCCCAAA GTGCTGGGAT TACAGGCATG
227341 AGCCACTGCG CCCAGCCCTG CTTGTCTTTT TATTTTATAT TTGATTAGCT TTATCTTTTA
227401 TCAAGCTTAT GTCCTATTTC CCTTTGCTTT ACTTCATATA AATTTTGTTT TGGATAGTTT
227461 ATTTATTTTT CATTTAATTA TGAAACAGGT TAAAGCTTAG AGGAAAATTG CTCCTCTAAG
227521 TCCACTTTTG TGGGCAGATT ACATTTGCT GTGTTGTGCT CCCAAATTCA TTGTTCTTTT
227581 AATGCTTTAT TTCTCAAGTT AATAACCTAT ATAGTAAAAA AGTGGCTGTT GACTCTCAGC
227641 TTTTTTTTTT TTTTTTTTTT TTTTTTGTA GATACAGGGA TCTTGCTGTG TTGCTCAGGC
227701 TGGTCTGAAA CTCCTGGCTT CAAGGGATCC TCCTGCCTTG GTCTCACAAA ATGCTGGGAT
227761 GACAGACATG AGACACCATG CCCAGCCATG TCTCTCTCCT TATATATAAT AAGAAAACAG
227821 ACACACTGAG GCATCCTATC ATCTCACTCT TGGTTTCACT ACTGTTCTCT GGAAGTTTTG
227881 CTCTGACCTT TTGCAGTTAA TGTATTAATT TTGCATTGAG TAGTTTCCAT AGAAGAATTA
227941 TAGCATTTGC ATTCTGTTGG GTATTATACT TTTCACTGTT ATTTGAACAT AATTTGAGGG
228001 CTGAAACCAA GATGAGGCAA GTGAGGTGCC CAGGAAGCAA TATTTAAGGA GGCATCCTTT
228061 CTTAGGCTCA TGCAAGAACA GAATTGGCAC ATGAGAGTGA GTGCCTCCTT AATTTTGAGT
228121 GCTGGACACT TCTTGCTCAC TTAGCATACC CCTGGACAAT GAAGTGTTTT TTGTTTTGTT
228181 TTTTCATGTC CATCCTTTAT CCTTCTTCAT CTCAAAACAT TTCAATGGAG TATTTTTTTG
228241 GAGCAGTACT TGGATGAGCC TCTGAGTCCC ACAGTAGCTG AGAATTTATT TCATAGTACT
228301 CTTTATGATC ACTGTGGAGC CTTAAAACAT TGTAATATTA ACTTAGCTGG GAACAGAAAT
228361 TTTGTTCCAC AATTTGTCTT ATTCAGAACA GTATTGACTT CCTGCTAGTC TCTTCTGATG
228421 TCCAATATGA GGAAGTCTAG TTAGCCAGCT ACTTTTTGTA GGAGAGCTAT GTTTAGGCTA
228481 GGTGCTATAG GATTCTCTTT ATCCTGGAAT TCCTTCACCA AGATGTGCCA AGGTGTTAAT
228541 CATTTTCTCT TGCTTTTTGG CTGGTGGTCT TAGAGTTTCC TTCGATTTTG TTTTATTTAG
228601 TGATTGTCCT CAATTTGTTT TCTTTACTAA GAATCTCTCT TCTATTTATC TGTATGGTAA
228661 AACCTTGTTG CCCATCTTTC TGGTTTCTGC TGACTTTCAT TTTTGGACCT TTTACTTTGC
228721 TTTCTCCATG GACTTTTTGG TAGTGGAGGC AGGCAAACAC TTTCCAAAGT CTTTCTCAAT
228781 TTCCATCAAT TTCAACTTAT TTCCTAAAAT TGCCTCAGAA TGTGCCTATG TCCACAATAT
228841 CCCTCCTTCC ACTTTAGAAA GGAAAGGCAT CCACACTTTA TTTAGGTGCA ATGCCTGAAG
228901 TGTAAACACT TTCTGGTTGT CAACAAAGGA GTACTTCCAA ATATTGGTTT GGGGATAACC
228961 TGCTAATGAT TAACACATTC ACCTTGGCTC TTGGTTTGCC TGCTCCCTCT TCTTTTATCT
229021 GCTGTGTGTA TTTTTTTTAA TCACTGAGAA TATGCACAGT ATTGTATGTT TTATTATAAG
229081 AGAGGACTGG CCAGAGTGGG AATGTTCTGA ATTCAGAATA ACTGAAGCAG TACAGGATAG
229141 GAACTCATTC TTTCAAATGA AGCTGGCATA TTTTCCCAGA GCACCAAATT TCAATATATA
229201 TTTAAAAAAC TTGATATGAA TGATACAATA AAGTGGTTAG AACTTTTATT AAAATAAACT
229261 TATGTCATGA AATACTTATT CTAATTATAG TCACTCTTCA TCTTATTTCA TCTTATAACA
229321 TGTTTAATGT TTTCTTTTAT TTACAAAACA ATTTATTTTT TGATGAAAAG TTTTAGAAAT
229381 CAAGTTAAAA ATATTCAAAG GAATGCCTAA AGTTTTCAAA ATTCTTTTAC ATGTTGTACA
229441 ATCAAAAGAG TCTGAAGACC ATTTAGCTAT CCAAATTGTT TATTTTTAAG CAGTATCCCT
229501 TCTAATATTT ACTATTTATA ATCCTTAAAA ATTTGCCTTA GCACAGGAGA ATTGCTTGAA
229561 CCCAGGAGAC GGAGGTTGCA GTGAGCCAAC ACAGTGCCAC TGCCCTCCAG CCTCGGCGAC
229621 AGAGTGAGAC TCTGTCTCAA AAAAAAAAAA AAAAAAAAAA AAAAAGGCC AAAAACAAAT
229681 AAACAAACAA AAAATCCGC CTTAACATTA TTTGTTCATT AAAAACTTTC TTTAATACTA
229741 CTAGTTTCCC TTTCCTCTCA GCCCATTGTC ATATTTTGAT TTTTATCACT TGCTTTGTAG
229801 GACATATGAG GTTTTGTTT TTTTTTTTTT TTGGAGATGC AGTCTCCCTC TGTTGCCCGT
229861 GCTGGAGTGC AATGGCGCAA TCTTGGCTCA CTGCAACCTC TGCCTCCTGG GTTCAAGCAA
```

```
229921 TTCTCCTGCC TCAGCCTTCC AAGTAGCTGG GATTACAGGC ACCCACTACC ACGCCTGGCT
229981 AATTTTTGTA TTTCTGGTAG AGACGGGGTT TCACCATGTT GGCCAGGCTG GTCTCGAACT
230041 CCTGACCTCA AGTGATCCAC AATCCTTGGC CTCCCAAAGT GCTATGATTA CAAGCATGAG
230101 CCACCTGCCC AGCCAGAATA TATGTTCATT TTGAGTCCTT TAACAAAGTC ATAAGAATTT
230161 TAGGAATTCA GTTACTTTCT TGAGAAAATC TCTGAAAAGA TGCCAATAAT TTGTAGCCAA
230221 TTATATTGAT TTCTCTTTTT CATATTGAGA ATTGTTTTTT AAAAAGTTTG TATGTGTGAA
230281 GATTTTTGCA CTGTAGTTAA AGAAACCACC TGTGTGTTGG TTAAGCCATA AGTACATGTA
230341 TTCAAATAAA TTGAGGTGGG GTTACTCTGA GAATCAAAGG AAAACCTGAA GAAACAGGCA
230401 GCCTCAAAAG GTCTTAGCTG TAGCAACTTG CTCCATTGTT GAAATAAATA GGCTTGAACT
230461 TGTATTTTCC CTCTACTCAA CATTTAAGGT CTCAGAAGAT AATATAATTG GTGAAATTTA
230521 AGTAAAGTGC TCACTCTTTT GCTTTAACAA ACCCTAGAGA GCTGGTAGGC AGAGCCTCAA
230581 CAGACCGTTT TAGCTTCCAA AGGGAGTTCA GGACACCATG ATTCACGACC ACAATACATC
230641 ACACATAATT GAGAAAAGAT AGTTCCACCA AATAAAGTTG AAATGCTGAC AAGAAGGGGT
230701 AAGAAATCTT GGAAATAGGT TTATATAAAA TTTATTTTTT CCTTTTTTAT TGTTATGGAA
230761 TAGGACCAGT TCTACTTAAG CCACCCATTT GCCAAAATAA AGTGAGAATC GTTTCTTTTG
230821 GGGACTCCTC TTTGTAGCTC CAAGTGCCAC TAACAATTCT TAGGACCTGA GCTATAAGCC
230881 AGGTGATTTC AGTTAATATG ATCAATTATT TCATTTAAAT GGCTCTAATG TGCAGAGGGA
230941 ACGGAGCCCA TCAGCATTCC CTGCAGGGAA CTGCAGTGGC TTTTATCAAC TTGAACAGCT
231001 AGCTTTCAAC TGTTTTGAAA TCACTTTCAG GGTGGTCATG TAGTTGCTTT TTTGAAATCA
231061 GAAGATGATT CTGCCTCTTT TAATATGTGA CTCCTCAGAT TCAGAAAGTG CTCGCTAGTC
231121 TTAAGAGTGA ATTACCCTCA GTGGTCCAGC GCTTATGAAC CCACATCTAA CCCTATCCCC
231181 TGGGGAACT  ATCAGAGAAA TTGGTGCCAT GGACATAAGA GGAAGGCACA GTGAAGCAGA
231241 GAGCCCCGCA TGATGAAAAT CAGTGGACAG CATCATTATT TACAACTTTG TAATCACCCA
231301 GGAGCATGAA AATCCAGGCC AATCTGGCAC CATGAGCTCT AATTTTTGTT GGAGTTCTTG
231361 GAACCGATTC TGATGAATGA CTGTTTAGCC ATTTTAGAGT GTGGCATACG TGGCTGCTGG
231421 CATACAGAGG TTGGATGTAA ACGGGCCTTT GCCCTCTCTT ATGAACATAG ACAGGAACTA
231481 AACTGTGTCA CATAGGTTCC AAATGGTGGC CTGAATACTA TTTACAACTA AGGTACAATG
231541 AAATTGAGTA AGTCTTTTCC TCTTTTGCAG ATACCATCAT TATTCATATA TTTCTTCAAA
231601 GTTAACTATT TGTATTTGGT AATTTTTAAT AGAAATGTAA TAATTGCTTC TCAAGTTTAG
231661 TCTTTAGTCT TAAGGTTGAT GCTCTCCATG TCCTTCCAAA AAAAGGTATG TTGCTTTTAT
231721 TATATCCTCG CCTTCAGATG GGATTATTCC ATTTTGTTCT TTGTTAATAT ATACTTTGAG
231781 CCACTTTTTT TGTGGCTCTG GGTGAGATGC TATAGGTACA ATGACAAGTG ATACGTGTGT
231841 TGTCCCTGTC ACAAAAGTGG ATAGCCTAAG TGGTGACTTT TACCTCCACT CCAAATATAT
231901 GTATCACACA CCAGCCGTAT GCCAGGCACC ACTCTAGGTG CTAGGGATAC AGCAGTAAAC
231961 AGACAAATGC AACCCCTGCC CATGTGAAAG AGAATAAGAC AATAAATAAG TAAAGTGCAT
232021 GTTATATGGA GGTGGCAAAT GCTAAAAAGA AAAATTAAGC AGGCAAGAGG ACTCATTGAA
232081 AAGATGACAT TTGGGTAAAA GCCCATGTAT ATATGTTCTA TTGGTTTTAT TTCTCTGGAG
232141 AGCCCTGACT AATACACAAT GACTTTGAGA AGTTACTGGC TTTTGATTTA TCACACTATT
232201 CGGAGTGCTG AGAGCCTTCT TAGTGTGTAT TCAGTGTTTT AAGAGAGCTT GTGGATGAAT
232261 AATAAATAGG ACAAAATTTA TCCAAACTTA AGCCTTGCTT TAGGTAAAAG GGCTCCTCTT
232321 ACAAGGTAGA AGGTTATTAT TTGACATTTA AATCCAACTG AAGACTAATA AGACTAATTA
232381 ATTAAAAGTT TTTAAATCAC AACTGCGTGC AAAATAAATG GAACTGCCAT GCTCGCCAAG
232441 TGTGCATGAG TGGTGTGCAT GGGAGACAGC ACGAAGCTAA TCCCACTCAT CTTGCAGGTT
232501 GCTCCATTTT TCTCCTAAAA TCAGTAAGAC AGAAGCTGGT CAGATTATCA AGAGCCCTAG
232561 TTAAACACAG CAGTAGCATT TGGAAGGGCT TGCTCTCATT AGGCAGTGCC TGACCACAAC
232621 AAGAGATGAA CAAGCCCTGT ATCTGAAGCC ATCATGCCTA GTTATGGTCC CCGACTGTTC
232681 ATGATGCCTG GAAGGGAGGC CCCCTGCACC CTAGAAAGCT GGGTGGGTTC TACTGTCTGC
232741 TTTACTGCTA AAAACCCTCT TCTTTGGATC TGGACTTTAC CTCTATCTGA TTTTTTTTTC
232801 TAATATATGA TTTGGCACTG AGTCTGTCAC TGCTGCTAAC TCAGCAGTTC TAGGGTCATT
232861 GCCCCATTGC CTCACAGAAA GAATTTCATA GCTTCCAGCA TCCTCTCTCC TTCATTATAC
232921 TTTGATTTCA GCATTGCTAT TTTTTCTCTT GGGTGTTGCA GCTCTCTCTC TCCTTCCCAT
232981 GTCTTGTTGG TTTTCTGCTA ACTCCTGCTT TTTTTCTTTT TTTTTTTTG AGACGGAGTC
233041 TCGTTCTGTC ACCCAGGCTG GAGTGCAGTG GCACAATCTC GGCTCACTGC AACCTCCGCC
233101 TCCCGGGTTC AAGCTATTCT CCTGCCTCAG CCTCCCAAGT AGCTGGGACT ACAGGCGCTC
```

```
233161 ACCACTATGC CCCACTAATT TTTGTATTTT TAGTATTGCT GTCATCAATC CACATGTCCA
233221 GAAGCACCTA GAAACTCTAA TTCTTTGTAG GTATCAAACC CTAGGACTCT TTCCTCTAAT
233281 CACAATATAT AATCCCTGAT TCCCAAACAC GGTCTTTTCA TATACATTTT CCACTGTACA
233341 TACTTTCTGA CCTGGAAAGC TCTTACACAA ACACGCCCTC CCCTAGGAAG CCTTTATAAA
233401 TGTTCCCAGG AAGAATCAGT CACCCAACAG TGTCCTTGTC ACATCTTAGG TTCTACACCT
233461 TTATTTGTTC TATCTGAATG TAATCTCCCA GAGGGTGTTA TCATCTTTTT TTTTGAGATG
233521 GAGTCTTGCT TTGCTGCCCA GGCTGGAGTG CAGTGGCATG ATCTCGGCTC ACAGCAACCT
233581 CCACCTCCTG GGTTCAAGTG ATTCTCCTGC CTCAGCCTCC TGAGTAGCTG GGATTACAGA
233641 CGTGTGTCAC CACACCTGGC TAATTTTTGT ATTTTTAGTA GAGACAGGGT TTCACCGTGT
233701 TGGCAAGGCT TTCCTCGAAC TCCCAAACTC AGGTGATCCA CCCACCTCAG CCTCCCAAAG
233761 TGCTGGGATT ACAGGTGTGA GCCACCATGT CCAGCCCAT CTTTTTCTTT TAGTTTAGTT
233821 CTTAACAAAT AGTCTGACAC AAAGTGGATA TAACAATATT TGAATTATG AATAACTAAA
233881 TGAATATTTC CAGATTTCCT GGTGCTCTCA AGTTTTATG TTACAAAAGA AAAACAAGTC
233941 TAAAATACCT GCCTCAAGTT TTTATCTGTA CTATGATTTC AAACCAAATA AAAAACAGGT
234001 GGGGTAAAAA CTGAAACAGG AAATACATAT AACTGAAAAA TTTTGGTATG TTAGTATGAT
234061 AATACTAGGT CATTTTTCCT GTTTCCCCAA CTTCATTTTC TATAGCAATA AAAAGAAACA
234121 AGTAAATGTA TGTTAATTTA ATTTAAAAGA AGTAGTCTAC CATCTCTTCT GTTAAAAAGA
234181 AAAAAGTATT TTAAAAAATT ATCTCTGGAA GGATACACAG GAACATTGC TCTGGTTTCT
234241 TCCAAGAGAG AAATGAGGAA CTAGAGAGCA TGGCCAAGTG GGGTTTTGCT TTTGTTTTTG
234301 TTTGTCTATC TGTTAGCTTT TTATTATTTT CTTTTGTAGG TTTGAATTTC AAACCACATA
234361 AATCTGTTAC ATGCTCATAA TAATAAGTTT AAAATAAAAC TTTTGGCTGG GTGCAATGAC
234421 TTACACCTGT AATCCCAGCG CTTTGGGAAG CAGAGGTGGG AGGATACTTG AGGCCAGGAA
234481 TTTGAGATCA GCCTGGGCAA CATAGTGAGA CCCTGCCTCT GTAGAAATAA ACAAAAATTA
234541 GCTGGATATG GTGGTGCATG CTTGTACTCC TAGCTACTTG GGAGGTTGAG GCAGGAGGAT
234601 CCTTTGAGTC CAGGAGTTTG AGGCTGCAGT GAGCTATAAT CACCCACTGC ACTATAGCAT
234661 GGGCAATAAG GTGAGAACTT GTCTCAAAAA AAAAAGGGGG GGGGAAACA AATAAATAAA
234721 TATAAACAAA ACTTTTGTTT CAAAATATGT AATATTTAGC ACTAAAGAAT TCTGAATTGT
234781 AGAGCTAAAA AGTACTTAAA AGTTAATAAC TATTGTCTCC TTTAAAAGAA TTGTTATCAA
234841 AGTATAATTT TTATCCAGAA AATCATCCAT ATCAGCAAGC TAAACTTTCT CAAAATGACA
234901 TATCCATGTA ATTAGCTCCC AGGTAATTAG CAGGCAGCCT CTACTCAGGT TGAGTATTCC
234961 TAATCTAAAA ATTGGAAATT CAAAATGCTC CAAAATCTGC AACTTTTGA ATGCTAACAT
235021 GATTCTCAAA GGAGTGCTCA TGGAGTATTT CAGATTTTGG ATTTTTGGAT TTGAGATACT
235081 CAGTATAATG CAAACATTCC AAATCTGAAA AAATCTGAAA TACTTCTGGT TCTAAGCATA
235141 AGGGATACTC AACGTGTGTT AGCTAATTAG ACCCTTCATG GTCTCTTCTA GACCTCAGCT
235201 TCTTCAAGGT AACCTCTATC CTCACTTCTA ATAGCATGAA CTTTTCTGTT TTAGAATAAT
235261 TTGGATTTTC AGGAAAGTTG CAAAGATAGT ACAAAGACAG TACAGGAGAG TTCCCATATA
235321 TCTTTCACCT AGCTTTCCCC CATTGTTAGG ATTTTACATT ATTATGATAC ATTTGTCAAA
235381 TATAAGCAAC TCACATTGAT ACATGAAACT CTATTAACCA AACCCTAGAC TTTATGTGGA
235441 TTTCACCACT GTTTCCACTA ATGTTTTCTT TCTGTTCCAA GGTCCAATCT GGAATACCAC
235501 ACTGCATTTT CTTGTCATAT CTCCCTAGTC TTTTTTTGTC TGTGACAATG TCTCAGTCTT
235561 TTCTTGCTTT TCATGACCTT AACAGTCCTG AAGATCATTT GCTTTTTTTT CATAATTACA
235621 CCGGAGTTAT AGATTTTTTG AAATAATACC ACAAGGGCAA AGGGCCCTTC TTGTCACATC
235681 ATTTTAGGGA GAACATGATA TCCACATGAC ATCACTGATA TTAACCTTCA TCATGTGGTT
235741 TAGGTAATGT TTCAGGTTTC TCTACTGCAA AGTGATTTTT TTCCCTTAAT TTAGCCCACC
235801 TGAACTTATC AATTTTGTTT CTTCCATGA CTAATACTTT TGTTATTATA GCTAAAACTT
235861 CATTGGGCC AAATCTTAGA TCATGTAAAT TTCTTCTAT ATTTTATTCT AAAAGCTTGT
235921 AATGTTTGAT ACATTCTAAA AGATGTAATG TTTGATACAT TACATCTAGT CCTTTGATTT
235981 ATTTTAGTT ACTTTTGTAT AAGGTGTGAG AGATGTCTCC AGTTTCACTT TATTAACACA
236041 TTGTGGTGTT CCAGTACTAT TTGTTGCTAA GACTATCTTT TTTCCATTGA TTACCTTTGC
236101 CTTAGTTGGC AATATTTTTG TTGGTTTATT TCTAGACTGT TTATCTCATT CCACTGATTT
236161 GTGTCTATCT TTTTGACAAA ACTGTTGATT ACAGTAAGCT TTGAAATAGT TCATTTTTTG
236221 TGTCAACTTG ACTGAGTCAG GGGATAACCA GCTATCTGGT TAAACATTAT TTCTGGCTGT
236281 GTTTGTGAGC GTGTTTCTGG ATGAGATTAG CCTTTGAATA GGTGATCCTA GTAAAGTAAA
236341 CTGTCTTTCC CAGTGTGGAT GGCATTATGC CACCTGATAT TCAGGGTCTG AATAGAAGAA
```

Figure 2 (Page 73 of 74)

```
236401 AAGGCAGAGG AAGGGGGAAT TTGGGCCTTT TTTTCTGCCT CACTGCTTGA GCTGGGACAT
236461 CTCATCTGGT CTCCTGCTCT TGAACTGGGA TTTACATCAT CAGTTCCTCT GGTTCTCAGG
236521 CCTTCAGATT CAGACTGAAT CATACCACCA GCTTTCCTGG GTCTCCAGCT TGCAGATTAC
236581 AGATCATGGG ACTCCTCATC TTCCATAAAT GCATGAGCCA ATTCAGTCTA TGTCCTTGAA
236641 AACTGCCCCA CTGCAGATTA AGGCTTTTTT CCACTAGGTG AAATAAAGAA GCTTGTTAGA
236701 CAGATTTCCC TTCATCCAGT GCCCTCTCCT CTTTAAGTTA CAACACATTG GCTACACCTA
236761 AGTGCAGGGG TGGGGATGAG GGTATAGTCC TCTTGTTTGC TGAGAAGAGA ACTGTATTGG
236821 GAAAGCTCTA GAAGTGTTTG ATACATACAT AAACAAGGCA TGGTTTTTGC ACTTAATTTC
236881 ACATTACATT TTTCCCAGAA AAAAAGGAAT GTATAGGCAT CACGTAACTG TACTAGCTGG
236941 AGTCATTCTT CCTGATTATC AAAGGTAAAC AGTTATTAAT CCTATACCAA GATGTCAAGG
237001 AGAAGTACTT TTGGAACACA AGGAATTCTC TGGGAGTCCT TACTACTCTC AAGCCCAGTG
237061 AAAAAGTTAA TGAAAAACTA TAGTACCTTC CTATAAGCTG ATGACTAAT TACCAGGCTC
237121 ATTTAGGAAT TTGCCTTACC AAGTAAAACA TAAGGGCAGC TGAGGTGCTG ACTGAAGACA
237181 AATGGAGCAT AGAATAAGAG TAGTAAAGAA TGCCAAAAAT GCTGTCATGT ATCCATTGAC
237241 AAAAGGAGCT ATAAAGCCTT TAGGTATTTT CACACTTGCT CTGTTACGTA AATGTATGTG
237301 TGTGTGTGTG TGTGTGTGTG TGTGTG
//
```

Figure 2 (Page 74 of 74)

POLYMORPHISMS IN THE REGION OF THE HUMAN HEMOCHROMATOSIS GENE

This application is a continuation-in-part of U.S. patent application Ser. No. 08/724,394, filed Oct. 1, 1996, now U.S. Pat. No. 5,872,237, which is a continuation-in-part of U.S. patent application Ser. No. 08/630,912, filed Apr. 4, 1996, now abandoned, and U.S. patent application Ser. No. 08/652,265, filed May 23, 1996, now U.S. Pat. No. 6,025,130, which are herein incorporated by reference in their entirety for all purposes.

BACKGROUND OF THE INVENTION

Hereditary hemochromatosis (HR) is an inherited disorder of iron metabolism wherein the body accumulates excess iron. In symptomatic individuals, this excess iron leads to deleterious effects by being deposited in a variety of organs leading to their failure, and resulting in cirrhosis, diabetes, sterility, and other serious illnesses. The gene which is defective in this disease was disclosed in copending U.S. patent application Ser. No. 08/652,265.

HH is typically inherited as a recessive trait; in the current state of knowledge, homozygotes carrying two defective copies of the gene are most frequently affected by the disease. In addition, heterozygotes for the HH gene are more susceptible to sporadic porphyria cutanea tarda and potentially other disorders (Roberts et al., *Lancet* 349:321–323 (1997). It is estimated that approximately 10–15% of individuals of Northern European descent carry one copy of the HH gene mutation and that there are about one million homozygotes in the United States. HH, thus, represents one of the most common genetic disease mutations in individuals of Northern European descent. Although ultimately HH produces debilitating symptoms, the majority of homozygotes and heterozygotes have not been diagnosed.

The need for such diagnostics is documented, for example, in Barton, J.C. et al. *Nature Medicine* 2:394–395 (1996); Finch, C.A. *West J Med* 153:323–325 (1990); McCusick, V. *Mendelian Inheritance in Man* pp. 1882–1887, 11th ed., (Johns Hopkins university Press, Baltimore (1994)); *Report of a Joint World Health Organization/Hemochromatosis Foundation/French Hemochromatosis Association Meeting on the Prevention and Control of Hemochromatosis* (1993); Edwards, C.Q. et al. *New Engl J Med* 328:1616–1620 (1993); Bacon, B.R. *New Engl J Med* 326:126–127 (1992); Balan, V. et al. *Gastroenterology* 107:453–459 (1994); Phatak, P.D. et al *Arch Int Med* 154:769–776 (1994).

A single mutation in the HH gene, designated 24d1 in copending U.S. patent application Ser. No. 08/630,912, gave rise to the majority of disease-causing chromosomes present in the population today. This is referred to herein as the "common" or "ancestral" or "common ancestral" mutation. These terms are used interchangeably. It appears that about 80% to 90% of all HH patients carry at least one copy of the common ancestral mutation which is closely linked to specific alleles of certain genetic markers close to this ancestral HH gene defect. These markers are, as a first approximation, in the allelic form in which they were present at the time the ancestral HH mutation occurred. See, for example, Simon, M. et al. *Am J Hum Genet* 41:89–105 (1987); Jazwinska, E.C. et al. *Am J Hum Cenet* 53:242–257 (1993); Jazwinska, E.C. et al. *Am J Hum Genet* 56:428–433 (1995); Worwood, M. et al. *Brit J Hematol* 86:863–866 (1994); Summers, K.M. et al. *Am J Hum Genet* 45:41–48 (1989).

Several polymorphic markers in the HH region have been described and shown to have alleles that are associated with HH disease. These markers include the published microsatellite markers D6S258, D6S306 (Gyapay, G. et al. *Nature Genetics* 7:246–339 (1994)), D6S265 (Worwood, M. et al. *Brit J Hematol* 86:833–846 (1994)), D6S105 (Jazwinska, E.C. et al. *Am J Hum Genet* 53:242–257 (1993); Jazwinska, E.C. et al. *Am J Hum Genet* 56:428–433 (1995)), D6S1001 (Store, C. et al. *Hum Molec Genet* 3:2043–2046 (1994)), D6S1260 (Raha-Chowdhury et al. *Hum Molec Genet* 4:1869–1874 (1995)) as well as additional microsatellite and single-nucleotide-polymorphism markers disclosed in co-pending PCT application WO 96/06583, the disclosure of which is hereby incorporated by reference in its entirety. Additionally, copending U.S. patent application Ser. No. 08/630,912 disclosed additional markers 24d2 and 24d7.

The symptoms of HH are often similar to those of other conditions, and the severe effects of the disease often do not appear immediately. Accordingly, it would be desirable to provide a method to identify persons who may be destined to become symptomatic in order to intervene in time to prevent excessive tissue damage associated with iron overload. One reason for the lack of early diagnosis is the inadequacy of presently available diagnostic methods to ascertain which individuals are at risk, especially while such individuals are presymptomatic.

Although blood iron parameters can be used as a screening tool, a confirmed diagnosis often employs liver biopsy which is undesirably invasive, costly, and carries a risk of mortality. Thus, there is a clear need for the development of an inexpensive and noninvasive diagnostic test a for detection of homozygotes and heterozygotes in order to facilitate diagnosis in symptomatic individuals, provide presymptomatic detection to guide intervention in order to prevent organ damage, and for identification of heterozygote carriers.

SUMMARY OF THE INVENTION

One aspect of the invention is an oligonucleotide comprising at least 8 to about 100 consecutive bases from the sequence of FIG. 1 (SEQ ID NO:1) or FIG. 2, (SEQ ID NO:2) or the complement of the sequence, wherein the at least 8 to about 100 consecutive bases includes at least one polymorphic site of Table 1.

Another aspect of the invention is an oligonucleotide pair selected from the sequence of FIG. 1 (SEQ ID NO: 1) or FIG. 2 (SEQ ID NO:2) or its complement for amplification of a polymorphic site of Table 1.

Another aspect of the invention is an isolated nucleic acid molecule comprising about 100 consecutive bases to about 235 KB substantially identical to the sequence of FIG. 1 (SEQ ID NO:1) or FIG. 2 (SEQ ID NO:2), wherein the DNA molecule comprises at least one polymorphic site of Table 1.

Another aspect of the invention is a method to determine the presence or absence of the common hereditary hemochromatosis (HH) gene mutation in an individual comprising:
  providing DNA or RNA from the individual; and
  assessing the DNA or RNA for the presence or absence of a haplotype of Table 1,
    wherein, as a result, the absence of a haplotype of Table 1 indicates the likely absence of the HH gene mutation in the genome of the individual and the presence of the haplotype indicates the likely presence of the HH gene mutation in the genome of the individual.

Another aspect of the invention is a method to determine the presence or absence of the common hereditary hemo chromatosis (HH) gene mutation in an individual comprising:

providing DNA or RNA from the individual; and assessing the DNA or RNA for the presence or absence of a genotype defined by a polymorphic allele of Table 1, wherein, as a result, the absence of a genotype defined by a polymorphic allele of Table 1 indicates the likely absence of the HH gene mutation in the genome of the individual and the presence of the genotype indicates the likely presence of the HH gene mutation in the genome of the individual.

Another aspect of the invention is a culture of lymphoblastoid cells having the designation HC14.

BRIEF DESCRIPTION OF THE DRAWINGS.

FIG. 1 (SEQ ID NO:1) depicts the nucleotide sequence of approximately 235 KB in the HH subregion from an unaffected individual.

FIG. 2 (SEQ ID NO:2) depicts the nucleotide sequence of approximately 235 KB in the HH subregion from an affected individual.

DETAILED DESCRIPTION

A. Definitions

Abbreviations for the twenty naturally occurring amino acids follow conventional usage. In the polypeptide notation used herein, the left-hand direction is the amino terminal direction and the right-hand direction is the carboxyl-terminal direction, in accordance with standard usage and convention. Similarly, unless specified otherwise, the left hand end of single-stranded polynucleotide sequences is the 5' end; the left hand direction of double-stranded polynucleotide sequences is referred to as the 5' direction. The direction of 5' to 3' addition of nascent RNA transcripts is referred to as the transcription direction; sequence regions on the DNA strand having the same sequence as the RNA and which are 5' to the 5' end of the RNA transcript are referred to as "upstream sequences"; sequence regions on the DNA strand having the same sequence as the RNA and which are 3' to the 3' end of the RNA transcript are referred to as "downstream sequences".

The term "nucleic acids", as used herein, refers to either DNA or RNA. "Nucleic acid sequence" or "polynucleotide sequence" refers to a single- or double-stranded polymer of deoxyribonucleotide or ribonucleotide bases read from the 5' to the 3' end. It includes both self-replicating plasmids, infectious polymers of DNA or RNA and nonfunctional DNA or RNA. The complement of any nucleic acid sequence of the invention is understood to be included in the definition of that sequence.

"Nucleic acid probes" may be DNA or RNA fragments. DNA fragments can be prepared, for example, by digesting plasmid DNA, or by use of PCR, or synthesized by either the phosphoramidite method described by Beaucage and Carruthers, *Tetrahedron Lett.* 22:1859–1862 (1981), or by the triester method according to Matteucci, et al., *J. Am. Chem. Soc.* 103:3185 (1981), both incorporated herein by reference. A double stranded fragment may then be obtained, if desired, by annealing the chemically synthesized single strands together under appropriate conditions or by synthesizing the complementary strand using DNA polymerase with an appropriate primer sequence. Where a specific sequence for a nucleic acid probe is given, it is understood that the complementary strand is also identified and included. The complementary strand will work equally well in situations where the target is a double-stranded nucleic acid.

The phrase "selectively hybridizing to" refers to a nucleic acid probe that hybridizes, duplexes or binds only to a particular target DNA or RNA sequence when the target sequences are present in a preparation of total cellular DNA or RNA. "Complementary" or "target" nucleic acid sequences refer to those nucleic acid sequences which selectively hybridize to a nucleic acid probe. Proper annealing conditions depend, for example, upon a probe's length, base composition, and the number of mismatches and their position on the probe, and must often be determined empirically. For discussions of nucleic acid probe design and annealing conditions, see, for example, Sambrook et al., *Molecular Cloning: a Laboratory Manual* (2nd ed.), Vols. 1–3, Cold Spring Harbor Laboratory, (1989) or *Current Protocols in Molecular Biology*, F. Ausubel et al., ed. Greene Publishing and Wiley-Interscience, New York (1987).

The phrase "nucleic acid sequence encoding" refers to a nucleic acid which directs the expression of a specific protein or peptide. The nucleic acid sequences include both the DNA strand sequence that is transcribed into RNA and the RNA sequence that is translated into protein. The nucleic acid sequences include both the full length nucleic acid sequences as well as non-full length sequences derived from the full length protein. It being further understood that the sequence includes the degenerate codons of the native sequence or sequences which may be introduced to provide codon preference in a specific host cell.

The phrase "isolated" or "substantially pure" refers to nucleic acid preparations that lack at least one protein or nucleic acid normally associated with the nucleic acid in a host cell.

The phrase "expression cassette", refers to nucleotide sequences which are capable of affecting expression of a structural gene in hosts compatible with such sequences. Such cassettes include at least promoters and optionally, transcription termination signals. Additional factors necessary or helpful in effecting expression may also be used as described herein.

The term "operably linked" as used herein refers to linkage of a promoter upstream from a DNA sequence such that the promoter mediates transcription of the DNA sequence.

The term "vector", refers to viral expression systems, autonomous self-replicating circular DNA (plasmids), and includes both expression and nonexpression plasmids. Where a recombinant microorganism or cell culture is described as hosting an "expression vector," this includes both extrachromosomal circular DNA and DNA that has been incorporated into the host chromosome(s). Where a vector is being maintained by a host cell, the vector may either be stably replicated by the cells during mitosis as an autonomous structure, or is incorporated within the host's genome.

The term "gene" as used herein is intended to refer to a nucleic acid sequence which encodes a polypeptide. This definition includes various sequence polymorphisms, mutations, and/or sequence variants wherein such alterations do not affect the function of the gene product. The term "gene" is intended to include not only coding sequences but also regulatory regions such as promoters, enhancers, and termination regions. The term further includes all introns and other DNA sequences spliced from the mRNA transcript, along with variants resulting from alternative splice sites.

The term "plasmid" refers to an autonomous circular DNA molecule capable of replication in a cell, and includes both the expression and nonexpression types. Where a recombinant microorganism or cell culture is described as hosting an "expression plasmid", this includes both extrachromosomal circular DNA molecules and DNA that has been incorporated into the host chromosome(s). Where a plasmid is being maintained by a host cell, the plasmid is either being stably replicated by the cells during mitosis as an autonomous structure or is incorporated within the host's genome.

The phrase "recombinant protein" or "recombinantly produced protein" refers to a peptide or protein produced using non-native cells that do not have an endogenous copy of DNA able to express the protein. The cells produce the protein because they have been genetically altered by the introduction of the appropriate nucleic acid sequence. The recombinant protein will not be found in association with proteins and other subcellular components normally associated with the cells producing the protein. The terms "protein" and "polypeptide" are used interchangeably herein.

The following terms are used to describe the sequence relationships between two or more nucleic acids or polynucleotides: "reference sequence", "comparison window", "sequence identity", "percentage of sequence identity", and "substantial identity". A "reference sequence" is a defined sequence used as a basis for a sequence comparison; a reference sequence may be a subset of a larger sequence, for example, as a segment of a full-length cDNA or gene sequence given in a sequence listing, or may comprise a complete cDNA or gene sequence.

Optimal alignment of sequences for aligning a comparison window may, for example, be conducted by the local homology algorithm of Smith and Waterman *Adv. Appl. Math.* 2:482 (1981), by the homology alignment algorithm of Needleman and Wunsch *J. Mol. Biol.* 48:443 (1970), by the search for similarity method of Pearson and Lipman *Proc. Natl. Acad. Sci. U.S.A.* 85:2444 (1988), or by computerized implementations of these algorithms (for example, GAP, BESTFIT, FASTA, and TFASTA in the Wisconsin Genetics Software Package Release 7.0, Genetics Computer Group, 575 Science Dr., Madison, Wis.).

The terms "substantial identity" or "substantial sequence identity" as applied to nucleic acid sequences and as used herein and denote a characteristic of a polynucleotide sequence, wherein the polynucleotide comprises a sequence that has at least 85 percent sequence identity, preferably at least 90 to 95 percent sequence identity, and more preferably at least 99 percent sequence identity as compared to a reference sequence over a comparison window of at least 20 nucleotide positions, frequently over a window of at least 25–50 nucleotides, wherein the percentage of sequence identity is calculated by comparing the reference sequence to the polynucleotide sequence which may include deletions or additions which total 20 percent or less of the reference sequence over the window of comparison. The reference sequence may be a subset of a larger sequence.

As applied to polypeptides, the terms "substantial identity" or "substantial sequence identity" mean that two peptide sequences, when optimally aligned, such as by the programs GAP or BESTFIT using default gap weights, share at least 80 percent sequence identity, preferably at least 90 percent sequence identity, more preferably at least 95 percent sequence identity or more. "Percentage amino acid identity" or "percentage amino acid sequence identity" refers to a comparison of the amino acids of two polypeptides which, when optimally aligned, have approximately the designated percentage of the same amino acids. For example, "95% amino acid identity" refers to a comparison of the amino acids of two polypeptides which when optimally aligned have 95% amino acid identity. Preferably, residue positions which are not identical differ by conservative amino acid substitutions. For example, the substitution of amino acids having similar chemical properties such as charge or polarity are not likely to effect the properties of a protein. Examples include glutamine for asparagine or glutamic acid for aspartic acid.

The phrase "substantially purified" or "isolated" when referring to a peptide or protein, means a chemical composition which is essentially free of other cellular components. It is preferably in a homogeneous state although it can be in either a dry or aqueous solution. Purity and homogeneity are typically determined using analytical chemistry techniques such as polyacrylamide gel electrophoresis or high performance liquid chromatography. A protein which is the predominant species present in a preparation is substantially purified. Generally, a substantially purified or isolated protein will comprise more than 80% of all macromolecular species present in the preparation. Preferably, the protein is purified to represent greater than 90% of all macromolecular species present. More preferably the protein is purified to greater than 95%, and most preferably the protein is purified to essential homogeneity, wherein other macromolecular species are not detected by conventional techniques.

The phrase "specifically binds to an antibody" or "specifically immunoreactive with", when referring to a protein or peptide, refers to a binding reaction which is determinative of the presence of the protein in the presence of a heterogeneous population of proteins and other biologies. Thus, under designated immunoassay conditions, the specified antibodies bind to a particular protein and do not bind in a significant amount to other proteins present in the sample. Specific binding to an antibody under such conditions may require an antibody that is selected for its specificity for a particular protein. A variety of immunoassay formats may be used to select antibodies specifically immunoreactive with a particular protein. For example, solid-phase ELISA immunoassays are routinely used to select monoclonal antibodies specifically immunoreactive with a protein. See Harlow and Lane (1988) *Antibodies, a Laboratory Manual,* Cold Spring Harbor Publications, New York, for a description of immunoassay formats and conditions that can be used to determine specific immunoreactivity.

As used herein, "EST" or "Expressed Sequence Tag" refers to a partial DNA or cDNA sequence of about 150 to 500, more preferably about 300, sequential nucleotides of a longer sequence obtained from a genomic or cDNA library prepared from a selected cell, cell type, tissue or tissue type, or organisms which longer sequence corresponds to an mRNA or a gene found in that library. An EST is generally DNA. One or more libraries made from a single tissue type typically provide at least 3000 different (i.e. unique) EST's and potentially the full complement of all possible EST's representing all possible cDNAs, e.g., 50,000–100,000 in an animal such as a human. (See, for example, Adams et al. *Science* 252:1651–1656 (1991)).

"Stringent" as used herein refers to hybridization and wash conditions of 50% formamide at 42° C. Other stringent hybridization conditions may also be selected. Generally, stringent conditions are selected to be about 5° C. lower than the thermal melting point (Tm) for the specific sequence at a defined ionic strength and pH. The Tm is the temperature (under defined ionic strength and pH) at which 50% of the target sequence hybridizes to a perfectly matched probe. Typically, stringent conditions will be those in which the salt concentration is at least about 0.02 molar at pH 7 and the temperature is at least about 60° C. As other factors may significantly affect the stringency of hybridization, including, among others, base composition and size of the complementary strands, the presence of organic solvents and the extent of base mismatching, the combination of parameters is more important than the absolute measure of any one.

B. Polymorphic Markers

The invention provides 397 new polymorphic sites in the rein of the HH gene. These polymorphisms are listed in Table 1. As described below, these polymorphisms were identified by comparison of the DNA sequence of an affected individual homozygous for the common ancestral HH mutation with that of an unaffected individual disclosed in copending U.S. patent application Ser. No. 08/724,394.

These polymorphisms provide surrogate markers for use in diagnostic assays to detect the likely presence of the mutations 24d1 and/or 24d2, in preferably 24d1, in homozygotes or heterozygotes. Thus, for example, DNA or RNA from an individual is assessed for the presence or absence of a genotype defined by a polymorphic allele of Table 1, wherein, as a result, the absence of a genotype defined by a polymorphic allele of Table 1 indicates the likely absence of the HH gene mutation in the genome of the individual and the presence of the genotype indicates the likely presence of the HH gene mutation in the genome of the individual.

These markers may be used singly, in combination with each other, or with other polymorphic markers (such as those disclosed in co-pending PCT application WO 96/06583) in diagnostic assays for the likely presence of the HH gene mutation in an individual. For example, any of the markers defined by the polymorphic sites of Table 1 can be used in diagnostic assays in combination with 24d1 or 24d2, or at least one of polymorphisms HHP-1, HHP-19, or HHP-29, or microsatellite repeat alleles 19D9:205; 18B4:235; 1A2:239; 1E4:271; 24E2:245; 2B8:206; 3321–1:98; 4073–1:182; 4440–1:180; 4440–2:139; 731–1:177; 5091–1:148; 3216–1:221; 4072–2:170; 950–1:142; 950–2:164; 950–3:165; 950–4:128; 950–6:151; 950–8:137; 63–1:151; 63–2:113; 63–3:169; 65–1:206; 65–2:159; 68–1:167; 241–5:108; 241–29:113; 373–8:151; and 373–29:113, D6S258:199, D6S265:122, D6S105:124; D6S306:238; D6S464:206; and D6S1001:180.

Table 2 lists the frequency of about 100 of the alleles defined by the polymorphic sites of the invention in the general population. As is evident from the Table, certain of these alleles are present rarely in the general population. These polymorphisms are thus preferred as surrogate markers in diagnostic assays for the presence of a mutant HH allele ("gene mutation") such as 24d1 or 24d2. Preferably, the frequency of the polymorphic allele used in the diagnostic assay in the general population is less than about 50%, more preferably less than about 25%, and most preferably less than about 5%. Thus, of the genotypes defined by the alleles listed in Table II, polymorphisms occurring at base 35983 and base 61465 of FIG. 1 (SEQ ID NO:1) are preferred.

It will be understood by those of skill in the art that because they were identified in an ancestral HH homozygote, the haplotypes defined by the polymorphic sites of Table 1 are predictive of the likely presence of the HH gene mutation 24d1. Thus, for example, the likelihood of any affected individual having at least two or more of any of the polymorphic alleles defined by Table 1 is greater than that for any unaffected individual. Similarly, the likelihood of any affected individual having at least three or more of any of the polymorphic alleles defined by Table 1 is greater than that for any unaffected individual.

Thus, for example, in a diagnostic assay for the likely presence of the HH gene mutation in the genome of the individual, DNA or RNA from the individual is assessed for the presence or absence of a haplotype of Table 1, wherein, as a result, the absence of a haplotype of Table 1 indicates the likely absence of the HH gene mutation in the genome of the individual and the presence of the haplotype indicates the likely presence of the HH gene mutation in the genome of the individual.

The markers defined by the polymorphic sites of Table 1 are additionally useful as markers for genetic analysis of the inheritance of certain HH alleles and other genes which occur within the chromosomal region corresponding to the sequence of FIG. 1 (SEQ ID NO:1) which include, for example, those disclosed in copending U.S. patent application Ser. No. 08/724,394.

As the entire nucleotide sequence of the region is provided in FIG. 1 (SEQ ID NO:1), it will be evident to those of ordinary skill in the art which sequences to use as primers or probes for detecting each polymorphism of interest. Thus, in some embodiments of the invention, the nucleotide sequences of the invention include at least one oligonucleotide pair selected from the sequence of FIG. 1 (SEQ ID NO:1) or FIG. 2 (SEQ ID NO:2) or its complement for amplification of a polymorphic site of Table 1. Furthermore, in some embodiments of the invention a preferred hybridization probe is an oligonucleotide comprising at least 8 to about 100 consecutive bases from the sequence of FIG. 1 (SEQ ID NO:1) or FIG. 2, (SEQ ID NO:2) complement of the sequence, wherein the at least 8 to about 100 consecutive bases includes at least one polymorphic site of Table 1. In some embodiments the polymorphic site is at base 35983 or base 61465 of FIG. 1 (SEQ ID NO:1).

It will also be appreciated that the nucleic acid sequences of the invention include isolated nucleic acid molecules comprising about 100 consecutive bases to about 235 KB substantially identical to the sequence of FIG. 1 (SEQ ID NO:1) or FIG. 2 (SEQ ID NO:2), wherein the DNA molecule comprises at least one polymorphic site of Table 1. Such isolated DNA sequences are useful as primers, probes, or as the component of a kit in diagnostic assays for detecting the likely presence of the HH gene mutation in an individual.

C. Nucleic Acid Based Screening

Individuals carrying polymorphic alleles of the invention may be detected at either the DNA, the RNA, or the protein level using a variety of techniques that are well known in the art. The genomic DNA used for the diagnosis may be obtained from body cells, such as those present in peripheral blood, urine, saliva, bucca, surgical specimen, and autopsy specimens. The DNA may be used directly or may be amplified enzymatically in vitro through use of PCR (Saiki et al. *Science* 239:487–491 (1988)) or other in vitro amplification methods such as the ligase chain reaction (LCR) (Wu and Wallace *Genomics* 4:560–569 (1989)), strand displacement amplification (SDA) (Walker et al. *Proc. Natl. Acad. Sci. U.S.A.* 89:392–396 (1992)), self-sustained sequence replication (3SR) (Fahy et al. *PCR Methods Appl.* 1:25–33 (1992)), prior to mutation analysis. The methodology for preparing nucleic acids in a form that is suitable for mutation detection is well known in the art.

The detection of polymorphisms in specific DNA sequences, such as in the region of the HH gene, can be accomplished by a variety of methods including, but not limited to, restriction-fragment-length-polymorphism detection based on allele-specific restriction-endonuclease cleavage (Kan and Dozy *Lancet* ii:910–912 (1978)), hybridization with allele-specific oligonucleotide probes (Wallace et al. *Nucl Acids Res* 6:3543–3557 (1978)), including immobilized oligonucleotides (Saiki et al. *Proc. Natl. Acad. Sci. U.S.A.* 86:6230–6234 (1989)) or oligonucleotide arrays (Maskos and Southern *Nucl Acids Res* 21:2269–2270 (1993)), allele-specific PCR (Newton et al. *Nucl Acids Res* 17:2503–2516 (1989)), mismatch-repair detection (MRD) (Faham and Cox *Genome Res* 5:474–482 (1995)), binding of MutS protein (Wagner et al. *Nucl Acids Res* 23:3944–3948 (1995), denaturing-gradient gel electrophoresis (DGGE) (Fisher and Lerman et al. *Proc. Natl. Acad. Sci. U.S.A.* 80:1579–1583 (1983)), single-strand-confirmation-polymorphism detection (Orita et al. *Genomics* 5:874–879 (1983)), RNAase cleavage at mismatched base-pairs (Myers et al. *Science* 230:1242 (1985)), chemical (Cotton et al. *Proc. Natl. Acad. Sci. U.S.A.* 85:4397–4401 (1988)) or enzymatic (Youil et al. *Proc. Natl. Acad. Sci. U.S.A.* 92:87–91 (1995)) cleavage of heteroduplex DNA, methods based on allele specific primer extension (Syvänen et al. *Genomics* 8:684–692 (1990)), genetic bit analysis (GBA) (Nikiforov et al. *Nucl Acids Res* 22:4167–4175 (1994)), the oligonucleotide-ligation assay (OLA) (Landegren et al. *Science* 241:1077 (1988)), the allele-specific ligation chain reaction (LCR) (Barrany *Proc. Natl. Acad. Sci. U.S.A.* 88:189–193 (1991)), gap-LCR (Abravaya et al. *Nucl Acids Res* 23:675–682 (1995)), radioactive and/or fluorescent DNA sequencing using standard procedures well known in the art, and peptide nucleic acid (PNA) assays (Orum et al., *Nucl. Acids Res.* 21:5332–5356 (1993); Thiede et al., *Nucl. Acids Res.* 24:983–984 (1996)).

In addition to the genotypes defined by the polymorphisms of the invention, as described in co-pending PCT application WO 96/35802 published Nov. 14, 1996, genotypes characterized by the presence of the alleles 19D9:205; 18B4:235; 1A2:239; 1E4:271; 24E2:245; 2B8:206; 3321–1:98 (denoted 3321–1:197 therein); 4073–1:182; 4440–1:180; 4440–2:139; 731–1:177; 5091–1:148; 3216–1:221; 4072–2:170 (denoted 4072–2:148 therein); 950–1:142; 950–2:164; 950–3:165; 950–4:128; 950–6:151; 950–8:137; 63–1:151; 63–2:113; 63–3:169; 65–1:206; 65–2:159; 68–1:167; 241–5:108; 241–29:113; 373–8:151; and 373–29:113, alleles D6S258:199, D6S265:122, D6S105:124, D6S306:238, D6S464:206; and D6S1001:180, and/or alleles associates with the HHP-1, the HHP-19 or HHP-29 single base-pair polymorphisms can also be used to assist in the identification of an individual whose genome contains 24d1 and/or 24d2. For example, the assessing step can be performed by a process which comprises subjecting the DNA or RNA to amplification using oligonucleotide primers flanking a polymorphism of Table 1, and oligonucleotides flanking 24d1 and/or 24d2, oligonucleotide primers flanking at least one of the base-pair polymorphisms HHP-1, HHP-19, and HHP-29, oligonucleotide primers flanking at least one of the microsatellite repeat alleles, or oligonucleotide primers for any combination of polymorphisms or microsatellite repeat alleles thereof.

Oligonucleotides useful in diagnostic assays are typically at least 8 consecutive nucleotides in length, and may range upwards of 18 nucleotides in length to greater than 100 or more consecutive nucleotides. Such oligonucleotides can be derived from either the genomic DNA of FIG. 1 (SEQ ID NO:1) or 2, (SEQ ID NO:2) or cDNA sequences derived therefrom, or may be synthesized.

Additionally, the proteins encoded by such cDNAs are useful in the generation of antibodies for analysis of gene expression and in diagnostic assays, and in the purification of related proteins.

D. General Methods

The nucleic acid compositions of this invention, whether RNA, cDNA, genomic DNA, or a hybrid of the various combinations, may be isolated from natural sources, including cloned DNA, or may be synthesized in vitro. The nucleic acids claimed may be present in transformed or transfected whole cells, in a transformed or transfected cell lysate, or in a partially purified or substantially pure form.

Techniques for nucleic acid manipulation of the nucleic acid sequences of the invention such as subcloning nucleic acid sequences encoding polypeptides into expression vectors, labeling probes, DNA hybridization, and the like are described generally in Sambrook et al., *Molecular Cloning—a Laboratory Manual* (2nd Ed.), Vol. 1–3, Cold Spring Harbor Laboratory, Cold Spring Harbor, New York, (1989), which is incorporated herein by reference. This manual is hereinafter referred to as "Sambrook et al."

There are various methods of isolating the nucleic acid sequences of the invention. For example, DNA is isolated from a genomic or cDNA library using labeled oligonucleotide probes having sequences complementary to the sequences disclosed herein. Such probes can be used directly in hybridization assays. Alternatively probes can be designed for use in amplification techniques such as PCR.

To prepare a cDNA library, mRNA is isolated from tissue such as heart or pancreas, preferably a tissue wherein expression of the gene or gene family is likely to occur. cDNA is prepared from the mRNA and ligated into a recombinant vector. The vector is transfected into a recombinant host for propagation, screening and cloning. Methods for making and screening cDNA libraries are well known. See Gubler, U. and Hoffman, B.J. *Gene* 25:263–269 (1983) and Sambrook et al.

For a genomic library, for example, the DNA is extracted from tissue and either mechanically sheared or enzymatically digested to yield fragments of about 12–20 KB. The fragments are then separated by gradient centrifugation from undesired sizes and are constructed in bacteriophage lambda vectors. These vectors and phage are packaged in vitro, as described in Sambrook, et al. Recombinant phage are analyzed by plaque hybridization as described in Benton and Davis, *Science* 196:180–182 (1977). Colony hybridization is carried out as generally described in M. Grunstein et al. *Proc. Natl. Acad. Sci. USA.* 72:3961–3965 (1975).

DNA of interest is identified in either cDNA or genomic libraries by its ability to hybridize with nucleic acid probes, for example on Southern blots, and these DNA regions are isolated by standard methods familiar to those of skill in the art. See Sambrook, et al.

In PCR techniques, oligonucleotide primers complementary to the two 3' borders of the DNA region to be amplified are synthesized. The polymerase chain reaction is then carried out using the two primers. See *PCR Protocols: a Guide to Methods and Applications* (Innis, M, Gelfand, D., Sninsky, J. and White, T., eds.), Academic Press, San Diego (1990). Primers can be selected to amplify the entire regions encoding a full-length sequence of interest or to amplify smaller DNA segments as desired.

PCR can be used in a variety of protocols to isolate cDNA's encoding a sequence of interest. In these protocols, appropriate primers and probes for amplifying DNA encoding a sequence of interest are generated from analysis of the DNA sequences listed herein. Once such regions are PCR-amplified, they can be sequenced and oligonucleotide probes can be prepared from sequence obtained.

Oligonucleotides for use as primers or probes are chemically synthesized according to the solid phase phosphoramidite triester method first described by Beaucage, S.L. and Carruthers, M.H., *Tetrahedron Lett.*, 22(20):1859–1862 (1981) using an automated synthesizer, as described in Needham-VanDevanter, D.R., et al., *Nucleic Acids Res.* 12:6159–6168 (1984). Purification of oligonucleotides is by either native acrylamide gel electrophoresis or by anion-exchange HPLC as described in Pearson, J.D. and Regnier, F.E., *J. Chrom.*, 255:137–149 (1983). The sequence of the synthetic oligonucleotide can be verified using the chemical degradation method of Maxam, A.M. and Gilbert, W., in Grossman, L. and Moldave, D., eds. Academic Press, New York, *Methods in Enzymology* 65:499–560 (1980).

E. Expression Once DNA encoding a sequence of interest is isolated and cloned, one can express the encoded proteins in a variety of recombinantly engineered cells. It is expected that those of skill in the art are knowledgeable in the numerous expression systems available for expression of DNA encoding a sequence of interest. No attempt to describe in detail the various methods known for the expression of proteins in prokaryotes or eukaryotes is made here.

In brief summary, the expression of natural or synthetic nucleic acids encoding a sequence of interest will typically be achieved by operably linking the DNA or cDNA to a promoter (which is either constitutive or inducible), followed by incorporation into an expression vector. The vectors can be suitable for replication and integration in either prokaryotes or eukaryotes. Typical expression vectors contain transcription and translation terminators, initiation sequences, and promoters useful for regulation of the expression of polynucleotide sequence of interest. To obtain high level expression of a cloned gene, it is desirable to construct expression plasmids which contain, at the minimum, a strong promoter to direct transcription, a ribosome binding site for translational initiation, and a transcription/translation terminator. The expression vectors may also comprise generic expression cassettes containing at least one independent terminator sequence, sequences permitting replication of the plasmid in both eukaryotes and prokaryotes, i.e., shuttle vectors, and selection markers for both prokaryotic and eukaryotic systems. See Sambrook et al. Examples of expression of ATP-sensitive potassium channel proteins in both prokaryotic and eukaryotic systems are described below.

1. Expression in Prokaryotes

A variety of procaryotic expression systems may be used to express the proteins of the invention. Examples include *E. coli,* Bacillus, Streptomyces, and the like.

It is preferred to construct expression plasmids which contain, at the minimum, a strong promoter to direct transcription, a ribosome binding site for translational initiation, and a transcription/translation terminator. Examples of regulatory regions suitable for this purpose in *E. coli* are the promoter and operator region of the *E. coli* tryptophan biosynthetic pathway as described by Yanofsky, C., *J. Bacteriol.* 158:1018–1024 (1984) and the leftward promoter of phage lambda (Pλ) as described by Herskowitz, I. and Hagen, D., *Ann. Rev. Genet.* 14:399–445 (1980). The inclusion of selection markers in DNA vectors transformed in *E. coli* is also useful. Examples of such markers include genes specifying resistance to ampicillin, tetracycline, or chloramphenicol. See Sambrook et al. for details concerning selection markers for use in *E. coli*.

To enhance proper folding of the expressed recombinant protein, during purification from *E. coli,* the expressed protein may first be denatured and then renatured. This can be accomplished by solubilizing the bacterially produced proteins in a chaotropic agent such as guanidine HCl and reducing all the cysteine residues with a reducing agent such as beta-mercaptoethanol. The protein is then renatured, either by slow dialysis or by gel filtration. See U.S. Pat. No. 4,511,503.

Detection of the expressed antigen is achieved by methods known in the art as radioimmunoassay, or Western blotting techniques or immunoprecipitation. Purification from *E. coli* can be achieved following procedures such as those described in U.S. Pat. No. 4,511,503.

2. Expression in Eukaryotes

A variety of eukaryotic expression systems such as yeast, insect cell lines, bird, fish, and mammalian cells, are known to those of skill in the art. As explained briefly below, a sequence of interest may be expressed in these eukaryotic systems.

Synthesis of heterologous proteins in yeast is well known. *Methods in Yeast Genetics,* Sherman, F., et al., Cold Spring Harbor Laboratory, (1982) is a well recognized work describing the various methods available to produce the protein in yeast.

Suitable vectors usually have expression control sequences, such as promoters, including 3-phosphoglycerate kinase or other glycolytic enzymes, and an origin of replication, termination sequences and the like as desired. For instance, suitable vectors are described in the literature (Botstein, et al., *Gene* 8:17–24 (1979); Broach, et al., *Gene* 8:121–133 (1979)).

Two procedures are used in transforming yeast cells. In one case, yeast cells are first converted into protoplasts using zymolyase, lyticase or glusulase, followed by addition of DNA and polyethylene glycol (PEG). The PEG-treated protoplasts are then regenerated in a 3% agar medium under selective conditions. Details of this procedure are given in the papers by J. D. Beggs, *Nature* (London) 275:104–109 (1978); and Hinnen, a., et al., *Proc. Natl. Acad. Sci. U.S.A.* 75:1929–1933 (1978). The second procedure does not involve removal of the cell wall. Instead the cells are treated with lithium chloride or acetate and PEG and put on selective plates (Ito, H., et al., *J. Bact.* 153:163–168 (1983)).

The proteins of the invention, once expressed, can be isolated from yeast by lysing the cells and applying standard protein isolation techniques to the lysates. The monitoring of the purification process can be accomplished by using Western blot techniques or radioimmunoassay of other standard immunoassay techniques.

The sequences encoding the proteins of the invention can also be ligated to various expression vectors for use in transforming cell cultures of, for instance, mammalian, insect, bird or fish origin. Illustrative of cell cultures useful for the production of the polypeptides are mammalian cells. Mammalian cell systems often will be in the form of monolayers of cells although mammalian cell suspensions may also be used. A number of suitable host cell lines capable of expressing intact proteins have been developed in the art, and include the HEK293, BHK21, and CHO cell lines, and various human cells such as COS cell lines, HeLa cells, myeloma cell lines, Jurkat cells, etc. Expression vectors for these cells can include expression control sequences, such as an origin of replication, a promoter (e.g., the CMV promoter, a HSV tk promoter or pgk (phosphoglycerate kinase) promoter), an enhancer (Queen et al. *Immunol. Rev.* 89:49 (1986)), and necessary processing information sites, such as ribosome binding sites, RNA splice sites, polyadenylation sites (e.g., an SV40 large T Ag poly a addition site), and transcriptional terminator sequences. Other animal cells useful for production of ATP-sensitive potassium channel proteins are available, for instance, from the American Type Culture Collection Catalogue of Cell Lines and Hybridomas (7th edition, (1992)).

Appropriate vectors for expressing the proteins of the invention in insect cells are usually derived from the SF9 baculovirus. Suitable insect cell lines include mosquito larvae, silkworm, armyworm, moth and Drosophila cell lines such as a Schneider cell line (See Schneider *J. Embryol. Exp. Morphol.* 27:353–365 (1987).

As indicated above, the vector, e.g., a plasmid, which is used to transform the host cell, preferably contains DNA sequences to initiate transcription and sequences to control the translation of the protein. These sequences are referred to as expression control sequences.

As with yeast, when higher animal host cells are employed, polyadenlyation or transcription terminator sequences from known mammalian genes need to be incorporated into the vector. An example of a terminator sequence is the polyadenlyation sequence from the bovine growth hormone gene. Sequences for accurate splicing of the transcript may also be included. An example of a splicing sequence is the VP1 intron from SV40 (Sprague, J. et al., *J. Virol.* 45: 773–781 (1983)).

Additionally, gene sequences to control replication in the host cell may be incorporated into the vector such as those found in bovine papilloma virus type-vectors. Saveria-Campo, M., 1985, "Bovine Papilloma virus DNA a Eukaryotic Cloning Vector" in *DNA Cloning Vol. II a Practical Approach* Ed. D.M. Glover, IRL Press, Arlington, Va. pp. 213–238.

The host cells are competent or rendered competent for transformation by various means. There are several well-known methods of introducing DNA into animal cells. These include: calcium phosphate precipitation, fusion of the recipient cells with bacterial protoplasts containing the DNA, treatment of the recipient cells with liposomes containing the DNA, DEAE dextran, electroporation and microinjection of the DNA directly into the cells.

The transformed cells are cultured by means well known in the art. *Biochemical Methods in Cell Culture and Virology*, Kuchler, R.J., Dowden, Hutchinson and Ross, Inc., (1977). The expressed polypeptides are isolated from cells grown as suspensions or as monolayers. The latter are recovered by well known mechanical, chemical or enzymatic means.

D. Purification

The proteins produced by recombinant DNA technology may be purified by standard techniques well known to those of skill in the art. Recombinantly produced proteins can be directly expressed or expressed as a fusion protein. The protein is then purified by a combination of cell lysis (e.g., sonication) and affinity chromatography. For fusion products, subsequent digestion of the fusion protein with an appropriate proteolytic enzyme releases the desired polypeptide.

The polypeptides of this invention may be purified to substantial purity by standard techniques well known in the art, including selective precipitation with such substances as ammonium sulfate, column chromatography, immunopurification methods, and others. See, for instance, R. Scopes, *Protein Purification: Principles and Practice*, Springer-Verlag: New York (1982), incorporated herein by reference. For example, antibodies may be raised to the proteins of the invention as described herein. Cell membranes are isolated from a cell line expressing the recombinant protein, the protein is extracted from the membranes and immunoprecipitated. The proteins may then be further purified by standard protein chemistry techniques as described above.

F. Antibodies

As mentioned above, antibodies can also be used for the screening of polypeptide products encoded by the polymorphic nucleic acids of the invention. In addition, antibodies are useful in a variety of other contexts in accordance with the present invention. Such antibodies can be utilized for the diagnosis of HH and, in certain applications, targeting of affected tissues.

Thus, in accordance with another aspect of the present invention a kit is provided that is suitable for use in screening and assaying for the presence of polypeptide products encoded by the polymorphic nucleic acids of the invention by an immunoassay through use of an antibody which specifically binds to polypeptide products encoded by the polymorphic nucleic acids of the invention in combination with a reagent for detecting the binding of the antibody to the gene product.

Once hybridoma cell lines are prepared, monoclonal antibodies can be made through conventional techniques of priming mice with pristane and interperitoneally injecting such mice with the hybrid cells to enable harvesting of the monoclonal antibodies from ascites fluid.

In connection with synthetic and semi-synthetic antibodies, such terms are intended to cover antibody fragments, isotype switched antibodies, humanized antibodies (mouse-human, human-mouse, and the like), hybrids, antibodies having plural specificities, fully synthetic antibody-like molecules, and the like.

This invention also embraces diagnostic kits for detecting DNA or RNA comprising a polymorphism of Table 1 in tissue or blood samples which comprise nucleic acid probes as described herein and instructional material. The kit may also contain additional components such as labeled compounds, as described herein, for identification of duplexed nucleic acids.

The following examples are provided to illustrate the invention but not to limit its scope. Other variants of the invention will be readily apparent to one of ordinary skill in the art and are encompassed by the appended claims.

EXPERIMENTAL EXAMPLES

I. Sequencing of 235 KB from a Homozygous Ancestral (Affected) Individual

In these studies the entire genomic sequence was determined from an HH affected individual for a region corresponding to a 235,033 bp (SEQ ID NO:1) region surrounding the HH gene between the flanking markers D6S2238 and D6S2241. The sequence was derived from a human lymphoblastoid cell line, HC14ATCC NO. CRL 12371, that is homozygous for the ancestral HH mutation and region. The sequence from the ancestral chromosome (FIG. 2) (SEQ ID NO:2) was compared to the sequence of the region in an unaffected individual disclosed in copending U.S. patent application Ser. No. 08/724,394 (a portion of which is provided in FIG. 1 (SEQ ID NO:1) to identify polymorphic sites. A subset of the polymorphic alleles so defined were further studied to determine their frequency in a collection of random individuals.

A. Cosmid Library Screening

The strategy and methodology for sequencing the genomic DNA for the affected individual was essentially as described in copending U.S. patent application Ser. No. 08/724,394, hereby incorporated by reference in its entirety. Basically, a cosmid library was constructed using high molecular weight DNA from HC14 cells. The library was constructed in the supercos vector (Stratagene, La Jolla, Calif.). Colonies were replicated onto Biotrans nylon filters (ICN) using standard techniques. Probes from genomic subclones used in the generation of the sequence of the unaffected sequence disclosed in 08/724,394 were isolated by gel electrophoresis and electroporation. Subclones were chosen at a spacing of approximately 20 KB throughout the 235 KB region. The DNA was labeled by incorporation of 32 P dCTP by the random primer labeling approach. Positively hybridizing clones were isolated to purity by a secondary screening step. Cosmid insert ends were sequenced to determine whether full coverage had been obtained, and which clones formed a minimal path of cosmids through the 235 KB region.

B. Sample Sequencing

A minimal set of cosmid clones chosen to cover the 235 KB region were prepped with the Qiagen Maxi-Prep system. Ten micrograms of DNA from each cosmid preparation were sonicated in a Heat Systems Sonicator XL and end-repaired with Klenow (USB) and T4 polymerase (USB). The sheared fragments were size selected between three to four kilobases on a 0.7% agarose gel and then ligated to BstXI linkers (Invitrogen). The ligations were gel purified on a 0.7% agarose gel and cloned into a pSP72 derivative plasmid vector. The resulting plasmids were transformed into electrocompetent DH5a cells and plated on LB-carbenicillin plates. A sufficient number of colonies was picked to achieve 15-fold clone coverage. The appropriate number of colonies was calculated by the following equation to generate a single-fold sequence coverage: Number of colonies=size of bacterial clone (in KB)/average sequence read length (0.4 KB). These colonies were prepped in the 96-well Qiagen REAL, and the 5' to 3' DNA Prep Kit, and AGCT end-sequenced with oligo MAP1 using standard ABI Dye Terminator protocols. MAP1 was CGTTAGAACGCGGCTA-CAAT (SEQ ID NO:3).

C. Genomic Sequencing

The MAP1 sequences from the cosmid clones HC182, HC187, HC189, HC195, HC199, HC200, HC201, HC206, HC207, and HC212 were assembled into contigs with the Staden package (available from Roger Staden, MRC). A minimal set of 3 KB clones was selected for sequencing with oligo labeled MAP2 that sits on the opposite end of the plasmid vector. The sequence of MAP2 was GCCGAT-TCATTAATGCAGGT (SEQ ID NO:4). The MAP2 sequences were entered into the Staden database in conjunction with the MAP1 sequences to generate a tiling path of 3 KB clones across the region. The plasmid 3 KB libraries were concurrently transformed in 96 well format into pox38UR (available from C. Martin, Lawrence Berkeley Laboratories). The transformants were subsequently mated with JGM (Strathman et al. P.N.A.S. 88:1247–1250 (1991) in 96 well format. All matings of the 3 KB clones within the tiling path were streaked on LB-carbenicillin-kanamycin plates and a random selection of 12 colonies per 3 KB clone was prepped in the AGCT system. The oligos -21 (SEQ ID NO:5), CTGTAAAACGACGGCCAGTC, (SEQ ID NO: 5) and REV: GCAGGAAACAGCTATGACC (SEQ ID NO:6) were used to sequence off both ends of the transposon. Each 3 KB clone was assembled in conjunction with the end sequence information from all cosmid clones in the region.

In some regions, the coverage of the genomic sequence by cosmids was incomplete. Any gaps in the sequence were filled by using standard PCR techniques to amplify genomic DNA in those regions and standard ABI dye terminator chemistry to sequence the amplification products.

D. Identification of Polymorphic Sites

The assembled sequence of the cosmid clones in connection with the PCR amplified genomic DNA (FIG. 2) (SEQ ID NO:2) was compared to the genomic sequence of the unaffected individual (FIG. 1) (SEQ ID NO:1) using the PASTA algorithm. Numeric values were assigned to the sequenced regions of 1 to 235,303, wherein base 1 refers to the first C in the CA repeat of D6S2238 and base 235,303 is the last T in the GT repeat of D6S2241 of the unaffected sequence (FIG. 1) (SEQ ID NO:1). Table 1 lists the differences between the two compared sequences. Note that previously disclosed (Feder et al., *Nature Genetics* 13:399–408 (1996)) polymorphic sites D6S2238 (base 1), D6S2241 (base 235,032), 24d1 (base 41316), and D6S2239 (base 84841) are not included in the list of new polymorphisms, although they are provided for reference in a footnote to the Table and were observed in the ancestral sequence. In the Table, a single base change such as C-T refers to a C in the unaffected sequence at the indicated base position that occurred as a T in the corresponding position in the affected sequence. Similarly, an insertion of one or more bases, such as TTT in the affected sequence, is represented as "TTT INS" between the indicated bases of the unaffected sequence. A deletion of one or more bases occurring in the affected sequence, such as AAA DEL, is represented as the deletion of the indicated bases in the unaffected sequence.

II. Characterization of Rare Polymorphisms

In this study about 100 of the polymorphisms of Table 1 were arbitrarily chosen for further characterization. Allele frequencies in the general population were estimated by OLA analysis using a population of random DNAs (the "CEPH" collection, J. Dausset et al., *Genomics* 6(3):575–577 (1990)). These results are provided in Table 2.

One single base pair difference, occurring at base 35983 and designated C182.1G7T/C (an A to G change on the opposite strand) was present in the ancestral chromosome and rare in the random DNAs. This change occurred in a noncoding region of the hemochromatosis gene near exon 7 approximately 5.3 KB from the 24d1 (Cys282Tyr) mutation. OLA was used to genotype 90 hemochromatosis patients for the C182.1G7T/C base pair change. The frequency for C occurring at this position in the patients was 79.4% as compared to 5% in the random DNAs. Eighty-five of the 90 patients assayed contained identical 24d1 and C182.1G7T/C genotypes. Four of the remaining 5 patients were homozygous at 24d1 and heterozygous at C182.1G7T/C; one was heterozygous at 24d1 and homozygous at C182.1G7T/C. The primers used for this analysis were as follows.

PCR primers for detection:

```
182.1G7.F   5'-GCATCAGCGATTAACTTCTAC -3'   (SEQ ID
                                            NO:7)
182.1G7.R   5'-TTGCATTGTGGTGAAATCAGGG -3'  (SEQ ID
                                            NO:8)
```

For the detection assay, the biotinylated primers used were as follows.

```
182.1G7.C   5' (b)CTGAGTAATTGTTTAAGGTGC -3'  (SEQ ID
                                              NO:9)
182.1G7.T   5' (b)CTGAGTAATTGTTTAAGGTGT -3'  (SEQ ID
                                              NO:10)
```

The phosphorylated digoxigenin-labeled primer used was: 182. 1G7 .D 5' (p) AGAAGAGATAGATATGGTGG —3' (SEQ ID NO:11)

A further rare single base pair change was detected at 61,465 bp. The inheritance pattern of this polymorphism, C195.1H5C/T (a G to A change on the opposite strand), is identical to that of 24d1. The frequency of T occurring at that position (C195.1H5T) observed in a set of 76 patients was 78.5% as compared to 5% in random individuals.

PCR primers for detection:

```
1951H5.3F  5'-GAATGTGACCGTCCCATGAG-3'       (SEQ ID NO:12)
1951H5.3R  5'-CAACTGAATATGCAGAAAAAGTACACC-3' (SEQ ID NO:13)
```

For the detection assay, the biotinylated primers used were:

```
1951H5.3.4  5' (b)AGTAGCTGGGACTCACGGTGT-3'  (SEQ. ID NO:14)
1957H5.3.5  5' (b)AGTAGCTGGGACTCACGGTGC-3'  (SEQ. ID NO:15)
```

The phosphorylated digoxigenin-labeled primer used was:

```
1951H5.3.6  5' (p)GCGCCACCACTCCCAGCTCAT-3' (SEQ ID NO:16)
```

These rare alleles are thus preferred surrogate markers for 24d1 and are especially useful in screening assays for the likely presence of 24d1 and/or 24d2.

All publications, patents, and patent applications cited herein are hereby incorporated by reference in their entirety.

TABLE 1

Polymorphic Sites in the HH Region

| BASE LOCATION | DIFFERENCE |
| --- | --- |
| 35–36 | AC DEL |
| 841 | T-C |
| 2662–2663 | TT DEL |
| 3767 | T-C |
| 3829 | C-G |
| 4925–4928 | TAAA DEL |
| 5691 | C-T |
| 6839 | T-C |
| 6011 | G-A |
| 6047 | C-G |
| 6231 | G-A |
| 6643 | A DEL |
| 6698 | T-C |
| 7188 | T-C |
| 7273 | G-A |
| 7545–7568 | TCACACACCGATTGG DEL |
| 7672 | G DEL |
| 7933 | T-C |
| 8746 | T-G |
| 9115 | G-A |
| 9823 | G-A |
| 10027 | G-A |
| 10214 | C-T |
| 10828 | A-G |
| 10918 | C-G |
| 10955 | A-G |
| 11524 | C-A |
| 11674 | A-G |
| 11955 | T-C |
| 12173–12175 | TTT DEL |
| 13304 | G-A |
| 13455 | G-A |
| 14418–14417 | A INS |
| 14996 | C-T |
| 15564 | T-C |
| 15887 | A-G |
| 15904–15919 | CCAAACTGATCTTTGA DEL |
| 16019 | T DEL |
| 16211 | A-T |
| 17461 | A-G |
| 19755 | G-A |
| 19949 | C-T |
| 20085 | C-T |

TABLE 1-continued

Polymorphic Sites in the HH Region

| BASE LOCATION | DIFFERENCE |
| --- | --- |
| 20366–20367 | A INS |
| 20463 | C-A |
| 20841 | A-T |
| 21059 | A-T |
| 21117 | A-G |
| 21837 | A-C |
| 22293 | A-C |
| 22786 | C-A |
| 23009 | G-A |
| 24143 | T-A |
| 26175 | G-C |
| 26667 | C-A |
| 26994 | T-C |
| 27838 | G-T |
| 27861 | T DEL |
| 28132 | G-A |
| 29100 | G-A |
| 29454–29457 | TTTT DEL |
| 29787 | T-G |
| 29825 | A-C |
| 30009 | T-C |
| 30177 | A-G |
| 30400 | A-G |
| 31059 | T-A |
| 31280 | C-T |
| 31749 | C-T |
| 32040 | C-G |
| 32556–32559 | TGTG DEL |
| 33017 | T-G |
| 33026 | T DEL |
| 34434 | C-T |
| 35179 | A-C |
| 36895 | G-A |
| 35702 | G-A |
| 36983 | A-G |
| 37411 | A-G |
| 38526 | C-T |
| 40431 | C-A |
| 42054–42065 | TT DEL |
| 43783–43784 | TTTT INS |
| 45120 | C DEL |
| 45587 | A-C |
| 46001 | A-T |
| 47255 | C-G |
| 47758 | C-A |
| 47994 | G-C |
| 48440 | G-A |
| 48650 | T-G |
| 48680 | A-G |
| 50240 | C-T |
| 50553 | G-A |
| 50586 | G-T |
| 51322 | G-C |
| 51747 | A-G |
| 52474 | C-G |
| 52733 | C-A |
| 52875 | G-A |
| 53631–53637 | TTTTTTT DEL |
| 53707 | G-A |
| 54819 | A-G |
| 55913 | T-C |
| 56225 | A-C |
| 56510 | T-C |
| 56566 | G-A |
| 56618 | A-T |
| 57815 | A-G |
| 58011 | T DEL |

TABLE 1-continued

Polymorphic Sites in the HH Region

| BASE LOCATION | DIFFERENCE |
|---|---|
| 58247–58248 | T INS |
| 58926 | C-G |
| 59406 | C-G |
| 59422 | G-C |
| 60221–60222 | A INS |
| 60656–60657 | CA DEL |
| 61162 | G-A |
| 61465 | G-A |
| 61607 | A DEL |
| 61653 | T-C |
| 61794–61795 | T INS |
| 62061 | G-C |
| 62362 | T-G |
| 62732 | C-G |
| 63364 | G-A |
| 63430–643431 | GT INS |
| 63754 | C-T |
| 63785 | A-C |
| 63870–63871 | A INS |
| 64788 | A-G |
| 64962 | G-A |
| 85891 | C-T |
| 66675 | G-C |
| 67186–67187 | ATT INS |
| 67748–67747 | TT INS |
| 68259 | T-C |
| 68835 | T-C |
| 68976 | C-G |
| 72508 | T-G |
| 72688 | C-G |
| 75323–75324 | T INS |
| 75887 | G-C |
| 77519 | T-C |
| 77749 | G-A |
| 77908 | T-C |
| 78385 | C-G |
| 78592–78593 | AG INS |
| 80169 | T-G |
| 80279 | T DEL |
| 80989–80990 | A INS |
| 81193 | T-C |
| 81273 | A DEL |
| 82166 | G-A |
| 83847 | T DEL |
| 84161–84162 | CA-GG |
| 84533 | A-G |
| 84638 | T-G |
| 85526 | T-G |
| 85705 | G-T |
| 86984 | T-C |
| 87655 | T-C |
| 87713 | A-C |
| 87892 | C-T |
| 88192 | T DEL |
| 88528 | A-G |
| 89645 | A-T |
| 89728 | A-G |
| 90085 | T-C |
| 91193–91194 | 2209bp INS |
| 91373 | T-C |
| 91433–91434 | A INS |
| 91747 | G-A |
| 93625 | T DEL |
| 95118–95117 | T INS |
| 96315 | G-A |
| 97981 | A-G |
| 98351 | T DEL |
| 99249 | C-T |
| 100094–100095 | T INS |
| 100647–100648 | TTC INS |
| 100951 | C-T |
| 101610 | C-G |
| 102589 | C-T |

TABLE 1-continued

Polymorphic Sites in the HH Region

| BASE LOCATION | DIFFERENCE |
|---|---|
| 103076–103077 | TATATATATATATA INS |
| 103747 | T-C |
| 105638 | A-C |
| 107024 | C-T |
| 101322 | C-T |
| 107858 | C-G |
| 109019 | A DEL |
| 109579 | T DEL |
| 110021 | C-A |
| 111251 | C-A |
| 111425 | G-A |
| 112644 | T-A |
| 113001 | G-C |
| 113130 | C-T |
| 114026 | G-A |
| 114250 | A DEL |
| 115217 | C-G |
| 117995 | G-A |
| 118874 | A-G |
| 119470 | T-C |
| 119646 | G-T |
| 120853 | C-T |
| 121582 | G-A |
| 123578 | A-C |
| 125581 | C-T |
| 125970 | G-T |
| 126197 | A-G |
| 126672 | A DEL |
| 126672 | G-C |
| 128220–128221 | A INS |
| 132569 | C-T |
| 133572 | A-C |
| 134064 | T-G |
| 136999 | G-A |
| 137784 | C-T |
| 138903 | G-A |
| 139159–139160 | A INS |
| 140359 | G-A |
| 140898 | C-T |
| 141313 | C DEL |
| 141343 | T-C |
| 142146 | T-C |
| 142178 | C-A |
| 142433–142434 | ATAGA INS |
| 143783 | C-T |
| 144090 | C-T |
| 144220–144221 | A INS |
| 144725 | A-C |
| 145732–145733 | AAAAAAAAAAAAAA INS |
| 147016–141017 | CG DEL |
| 147021 | G-T |
| 147536 | T-G |
| 148936 | T-A |
| 149061 | T-C |
| 154341 | A-T |
| 154588 | G-A |
| 155464 | G-A |
| 156574 | C-G |
| 160007 | C-T |
| 164348 | A-T |
| 164499 | C-G |
| 166677–166678 | AAAG INS |
| 167389 | G-A |
| 168506–168507 | AGGATGGTCT INS |
| 168515 | T-C |
| 169413–169414 | AA INS |

TABLE 1-continued

Polymorphic Sites in the HH Region

| BASE LOCATION | DIFFERENCE |
|---|---|
| 170300–170301 | TTGTTGTTGTTG INS |
| 170491 | G-A |
| 173426 | T-C |
| 173642 | G-A |
| 173948 | T-G |
| 175330 | T-C |
| 175836 | T-C |
| 176200 | G-C |
| 176222 | T-C |
| 176524 | A-T |
| 176684 | G-A |
| 176815 | T-C |
| 177049 | T-C |
| 177065 | G-T |
| 178285 | T-C |
| 178551–178552 | CTTTTTTTTTTTTT INS |
| 179114–179115 | A INS |
| 179260 | C-G |
| 179281 | C-G |
| 180023 | G-C |
| 180430 | T-C |
| 180773 | T-C |
| 180824 | T-C |
| 181097 | C-T |
| 181183 | A-T |
| 182351 | C-T |
| 183197 | G-A |
| 183623 | A-T |
| 183653 | G-T |
| 183657 | T-G |
| 183796–183796 | A INS |
| 184060 | G-A |
| 184993 | G-A |
| 185918 | A-G |
| 186038 | T-C |
| 186506–186507 | TAAC INS |
| 186561–186568 | TATTTATT DEL |
| 186690 | G DEL |
| 186751 | T-A |
| 187221 | A-G |
| 187260 | A-G |
| 187444–187447 | CTCT DEL |
| 187831–187832 | C INS |
| 188638 | G-A |
| 188642 | C-T |
| 189246 | T-C |
| 190340 | A-C |
| 190354 | A-G |
| 190762 | A-G |
| 191260 | G-T |
| 193018–193019 | AGAT INS |
| 193147 | T-G |
| 193196–193197 | C INS |
| 193499 | C-T |
| 193738 | C-G |
| 193964–193985 | ACACACAC INS |
| 194064 | C-G |
| 194504 | A DEL |
| 194734 | G-A |
| 194890 | A-C |
| 195404 | G-A |
| 195693 | A-T |
| 196205 | G-A |
| 197424 | C-T |
| 197513 | C-T |
| 197670 | G-A |
| 198055 | C-A |
| 198401 | C-T |
| 198692 | A-G |
| 198780 | T DEL |
| 199030 | T-G |
| 199933 | C-T |
| 200027 | G-A |
| 200439 | T-A |
| 200452 | A-G |
| 200472–200483 | AATAATAATAAT DEL |
| 200559 | A-T |
| 200745 | A-G |
| 200919 | T-A |
| 201816 | C-T |
| 201861–201862 | 42bp INS |
| 202662 | T-C |
| 202880 | T-C |
| 204341 | C-T |
| 204766 | A-T |
| 205264 | T-G |
| 207400 | C-A |
| 208634 | T-C |
| 208716 | T DEL |
| 208862 | A-C |
| 209419–209420 | TT DEL |
| 209602 | G-A |
| 209944 | C-G |
| 210299 | A-G |
| 211142 | G-A |
| 212072 | G-A |
| 212146 | T-C |
| 212379 | G-A |
| 212637–212639 | TCT DEL |
| 212696 | T-C |
| 213042 | T-A |
| 214192 | A-G |
| 214529–214530 | TTTTTTTTTTT INS |
| 214549 | T-C |
| 214795 | C-T |
| 214908 | T-G |
| 214977 | A-G |
| 215769 | C-T |
| 215947 | C-A |
| 216232 | A-G |
| 217478 | G-A |
| 219052 | T-C |
| 219082–219083 | ATATATATATATATATAT INS |
| 219314 | C-A |
| 219327 | G-A |
| 219560 | C-T |
| 219660 | C-T |
| 219889 | G-A |
| 220198 | G-T |
| 220384 | G-A |
| 220451–220452 | CAAAAA INS |
| 221363 | G-A |
| 221645 | G-A |
| 222119 | T-C |
| 222358 | A-G |
| 222367 | A-C |
| 222686 | A-G |
| 222959 | T-C |
| 223270–223271 | TT DEL |
| 223283 | T-C |
| 224964 | T-C |
| 225232 | A-C |
| 225366–225367 | TTTT INS |
| 225416 | G-C |
| 225466 | T-C |
| 226066 | A-G |
| 228421 | A-G |
| 230047 | G-A |
| 230109 | G-C |
| 230376 | C-G |
| 230394 | A-G |
| 231226 | A-G |
| 231447 | G-A |
| 231835 | A-G |

TABLE 1-continued

Polymorphic Sites in the HH Region

| BASE LOCATION | DIFFERENCE |
|---|---|
| 232400–232402 | AAA DEL |
| 232402–232403 | G INS |
| 232615 | T-C |
| 232703 | G-T |
| 232750 | A-G |

\* D652238 occurs at base 1. 2401 occurs at base 41316. D652239 occurs at base 84841, D852241 occurs at base 235032

TABLE 2

Polymorphic Allele Frequencies

| Location | Frequency of ancestral variant in random chromosomes | Frequency of unaffected variant in random chromosomes |
|---|---|---|
| 232703 | 53% | 47% |
| 231835 | 53% | 47% |
| 230394 | 85% | 15% |
| 230376 | 25% | 75% |
| 230109 | 53% | 47% |
| 225486 | 45% | 55% |
| 225416 | 75% | 25% |
| 220198 | 43% | 57% |
| 219660 | 58% | 42% |
| 219560 | 53% | 47% |
| 214977 | 65% | 35% |
| 214908 | 50% | 50% |
| 214795 | 24% | 76% |
| 214549 | 53% | 47% |
| 214192 | 66% | 35% |
| 210299 | 53% | 47% |
| 208862 | 80% | 20% |
| 208634 | 48% | 52% |
| 207400 | 25% | 75% |
| 205284 | 50% | 50% |
| 204341 | 53% | 47% |
| 202880 | 68% | 42% |
| 202662 | 98% | 2% |
| 200027 | 25% | 75% |
| 199030 | 58% | 42% |
| 198692 | 65% | 45% |
| 198401 | 55% | 45% |
| 198055 | 55% | 45% |
| 195693 | 60% | 40% |
| 195404 | 25% | 75% |
| 194890 | 55% | 45% |
| 175330 | 53% | 47% |
| 173948 | 83% | 17% |
| 173642 | 65% | 45% |
| 173428 | 80% | 20% |
| 168515 | 80% | 20% |
| 160007 | 18% | 82% |
| 149061 | 58% | 42% |
| 148936 | 82% | 18% |
| 147536 | 100% | 0% |
| 147021 | 46% | 54% |
| 141343 | 55% | 45% |
| 140359 | 55% | 45% |
| 138903 | 55% | 45% |
| 132569 | 81% | 19% |
| 125581 | 18% | 82% |
| 121582 | 80% | 20% |
| 120853 | 18% | 82% |
| 118874 | 85% | 15% |
| 115217 | 50% | 50% |
| 113130 | 40% | 60% |
| 113001 | 48% | 52% |
| 107858 | 48% | 52% |
| 103747 | 50% | 50% |
| 96315 | 25% | 75% |
| 91194 | 80% | 20% |
| 90088 | 75% | 25% |
| 89728 | 50% | 50% |
| 89645 | 50% | 50% |
| 88528 | 63% | 37% |
| 87692 | 75% | 25% |
| 87713 | 60% | 40% |
| 87655 | 50% | 50% |
| 86984 | 79% | 21% |
| 85705 | 50% | 50% |
| 85526 | 50% | 50% |
| 84638 | 50% | 50% |
| 84533 | 50% | 50% |
| 82166 | 78% | 22% |
| 81193 | 58% | 42% |
| 80189 | 50% | 50% |
| 78386 | 80% | 20% |
| 77906 | 88% | 12% |
| 68976 | 50% | 50% |
| 68259 | 51% | 49% |
| 66675 | 80% | 20% |
| 62732 | 50% | 50% |
| 62362 | 40% | 60% |
| 61653 | 48% | 52% |
| 61465 | 5% | 95% |
| 61162 | 60% | 40% |
| 53707 | 100% | 0% |
| 52875 | 50% | 50% |
| 52733 | 74% | 26% |
| 52474 | 47% | 53% |
| 50586 | 50% | 50% |
| 50563 | 50% | 50% |
| 50240 | 50% | 50% |
| 48680 | 53% | 47% |
| 48650 | 63% | 37% |
| 48440 | 50% | 50% |
| 47255 | 50% | 50% |
| 46601 | 53% | 47% |
| 46567 | 49% | 51% |
| 41316 | 5% | 95% |
| 40431 | 20% | 80% |
| 38526 | 23% | 77% |
| 37411 | 70% | 30% |
| 35983 | 5% | 95% |

SEQUENCE LISTING (26 sequences)

SEQ ID NO: 1 - DNA, 235033 bp; single-stranded, linear
cacacacacacacacacacacacacacacacacacaaatgaggtatataaagggtctcctaaaatgtcatctgatatttgttatttcatattctcagatttttaatccatttaggtaggtctattttagatagccttgtctgaaacagagctgggacctgatgagtgaaaatgagctcaccagaagaaaaatcaaacaggcatttcagagattgaggccaagaagttaaatgtcttaaatgggcagagcttagctgcttgatgtgaaaagagaccagcgtggctggaacagcaaaggagaacagcagaagaggtgaacagaggccagagatggtcactgagtgggcccttaagtcatggtaaggagtatggagaatgaattattgcatgtattgaatatgtaggtgacgtgactcacagatactttggatttgtagagatgaaggaaatgtagcaagtgacactcttagaatgttgatttgagtaaatggtagtgtcagttattgaactggggagaactggaagggataacaggcttaaggagcacgtttattcctgtgtcttggaagtgtttagggtgaaagacctattagagttctaaatggagatgtcaagtgaaaatgtggctacacacatttgcatttcagaaaaaaggtcaggctggagatgtaaaattggaagtttactgcatatagatagtctttggaaccgtagtattgatgaagccattaatgagacagaacaaagactagggaccagagccaagctccaagtttctaaaatttagaggatagtatagtctggtcattttgaggtgaatacttaataacagaacaatttgttgaagtgtaaatttagagccctacacttttagctctgactattaacgaatacaggaaagaatggatatggttatctgcctggtgtctgtgaaataatttaagccaggaagagatcctcaccagaaactgactatgctggcaacttggatcttagatttccagcctgcagaattgttagaaaataaatgtctatcgtttaagccaccagtctgtagtattttgttatggcagtccaagctgactaagttttggtacccaggcgtgggatgctgcaacaacaaatacctaaacatggggaagtggctttggaaattggtgatgggtaaaggctggaagagtttgaggttcatactagaaaaagccaattgtgaagggactattgaaagaaatatggacattaaaggcaattctggcaaaggctcagaaaggaagagagctggacagaaagcttccattttcatagaaacttagatttataacgatcatggatagaatattaaatatgctggttaaaatatggactttaggccaggcgtggtggctcacgcctgtaatctcagcactttgggaggctgagggcacagatcacgaggtcgggagtttgagaccagcctggccaatatggcgaaaccctgtctctactaaaaatacaaaaattagctgggcatggtgatgtgcttctgtggtcccagctactcgggaggctgaggctgaagaatcgcttaaacccggggggtggaggttgcagtgacccaagatcacaccactgcactccagcctgggatacagagcaggactccactccccccgccacacacacacaaaaaatatatatatatggacattaaagtcaactcttgtgaggtctcagatgaaaatgagggacaggttattggaaactgtagaaatcactgttcttgttacaatgtgtcaagaacttggctgaattacgctgtagtgtttactggaaagaacttataagcagtaaaactggatatttaccagaagagatgtctaagcaaagtattgaaggtgtgatttaggtcctccttactgcttaaagtgaaatgtgagaggaaagagccgaaataaagaaggaatttttaagcaaaacacaatcagaacttggagatttgggatagatttctcaatctatattgtaaaaattgagaaagtttttcttgaagaggtatggttgaacaatgttttctttttctttttttttcttggttttatttttatttttatgttttttgagacagggtctggctatgtcatccaggctggagtgcagtggcacaatctcagttcagtgcaacctttgccttcaggctcaagcaatcctcccacctcagcctcctaagtagctgggactacatgtatgcaccaccacaccctggctaattttttgttgttgtttatagagatggggttttgacatgttgcctaggctggtctctaactcctgagctcaagtgatctgccctcctcagtctcccaaagtgttgggattacaggcgtgaaacactgagcctagcctgaacaaccatttgataaagagataatgggtgtgacccaaggatttaatcagccatctcagcagaagccaggaagagagatgggattattccagcagagacactgccaatttaaactaacgtaggcagagaaaacagaaaggaacaaaggaaggttgtcgactttttgaattctatagaacaggatcatagagctacctggctgtcaatgtgtactattctttaagaaaaggaaagactgacccaccaaaggcaacttacaagatcactagggctgactcttttgttttttcttgaggcagtctcactgtcacccaggctgtagggcaatggtgtgatctcagctcactgcaatctccacctcccaggttcaagggattctcttgccttagactcccaagtagctgggattacaggctctaaatctgtaccctcccgagtagcgctcctgccaccacttgcccagctaatttttgtatttttagtagagatggggtttcactatgttggccaggctagtttggaactcctgacctccagtgatccattctcattggcctcccaaagtgctgggattacaggcaggagccgccagggctgccactttgatgtcagactcagagagtacagatgggatagggtgggggtgggaacatgtagtcaaggctgactctacctgtttcaaagatgccctgcagaactgtgtgggagtctctcacagatggctgcctgggtgggaccccaccaaactgaaagaccgagacttcaggcagggcagatggagtaggccaactacagagccagaggtgacactgagacaccactgggcctggaaatcagggcatcaagccaaagagggtttttcttaagacctaacagaatttgccttgccaggttttggacttgattaggacacattacaccttccttctttcctatttctccattttctaatgggaatgtctattatgcctgtttcaccattgtaccttagaagcatgtaacatttctggtttcacacgttcaaagctggaaaggaattttgtctctggatgaatcacacattgagcctcacccgtaacctgatttagatgattttttagatgacactttgaactttagaattgatgctagaatgagttaagactttcagggggctgttgggatggaataattttttttttttttttgagacggagtctagctctgtcgcccaggctggagtgcagtggcaccatcttggctcactgcaagctctgcctcccgggtttatgccattctcatgtctcagcctccagagtagctgggactacaggcgcccgccaccacgcctggctaattttttttttattttagtagagatggggtttcaccgtgttagccagaatggtctcgatctcttgaccttctgatccgcctgccttggcttcccaaagtgctgggattacacgtgtgagccaccatgcccggctgggatggaataaatttatcttgtatgggagaaggacatacattttggcaggtcaaggacagaatgttatggactaaactgtgtcccccaaaattcatttattaaaaccctaaaccccagtgtgactgcatttggacatagagcctttagggggtacataaaactaaagatcacaggatagggccctaatcccattggggctggtgtccttacagaagatgagacacttagagctctctctccacgcaggcaccaaggaaacaccatacaaacacacagtgagatggcagccatctgttagccaggaacagattctcaccataaactatgttggcaccttgatcttaaacttccaggctccaaaactgtgagaaaatgaatttctgttccaagcctcttagatatggaaaaaaagattctgttgtttaagccatccagtctctggtattttgttatggcagcctgagtaggctaagacaatgaaggatgtggtaaaactttacgtcccaaccacataccaaagaggctggaatttagcatgctttcttctttcaactgtaggcaatgtgcacaagttctaaatcctaagacatgttggctcctttactctgcccaaactacaactcaaacaaacaactgtaatataataacatccaatgaagttctgacatttcttcaacatgagtacagtaattcaatgccagagaattcattttattttgaaatctacatgccatattccaatttctgttgaagatgcaatggttatatttattctttttaatatagatttatcagactgggcgcggtggctcatacctgtaatcctagcatttgagaggctgaggtgggcatatcacctgaggtcaggagtttgagaccaggctggccaacatggtgaaaccctgtctctactataaatataaaaattagctgggtgtggtggtgcatgcctgtagtcccagttactagggaggctgaggtagaattgcttgaacctgggagcaggaggttgcaatgagtggaaatcgcaccagtacactccagcctggatgacagagcaaaataataaataaatacataaaatagatttatcagtttatcaataatatagttttcttttctaggtgtaaatataggtaatgactgtcctttagtacattttctcatgatgctcctcttacttggtttggtacaatattaagtattgaaataaaatagagaatcctgtcgctacacatgagcacttattccatttgctcatctccaatatgcacgggaaattctcaaattgctaataatcttgtaacacacatgcattatattcaacaggaatatataaatttataattataatttaggatcaacagatgacaaacctttagaaggtttgtatttaaccttaaaatataattttttaaaaattggttataaaatttctaatactttcttttttgtgacctcaaggggaaaatataattcttataaaagttcaaatgatttacagaatacaaaaagtgaatagagatgatgaatgaattaaaggaaaggatattgctacatagatttggaaatttaaaaagggaaattacgattgttgattttgtgttaaactgatctgctttgttcaagataccttatgtaccaaaaaatgattttatctcagcctcatatctcagtaaattcctgagacaaactttagtccctggtgcccaggtgcctttggtaattgggagacctctaggtttagcatcctcatccactcgccccaatttaaatagtcctccccagggccattcaggcaagggagatgaaaacttgctcaagagttggaatccaactgaagctaccgaaattcattgctcaatagataattttccctggaagtaactagggcttttgaatataatagtgggcatttcaaagtagaaggtaaagtattttggagatgaggagacaggacagagctacgaggaatgtcctttgcttagggactaggctcttagcagtacctcttaggtaagaactggttaactggcaccttctgtgtttctctgaagctccctttgcttagggactaggctcttagcagtacctcttaggtaagaactggttaactgacaccttctatgtgtctgaagctcccagaacaaactgccagtgaaatttggatttttggaatatagtttcttttttcttgttactttttgttttgttgtttttttttgagagtctcactctcactgcaacctccccctcctatattcaagtgattctcttgcctcagcctcccgagtagctgggactacaggcgtgcactagcatgcccagctaatttttgtattttttagtagagatggggttggtttttttttgagacggagtttcactttgtcgcccaggctggagtgcagtggcacgatcttggctcactacaacctccacctcccggggttcaagtgattcttctgcctcagtctcctgagtagctgggactacaggcgcctacaggtgaacaccgccacacctgactaatttgtgtagttttattagagatggggtttcgccatgttggccaggctggtctcaaactcctgacctcaggtgatctacccacctcagcctccccaagtgctgggattacagatgtgagacaccagatcagcctcagaagacattttctattggaaagagaaaacactattagcaacctattagtctaatatttaatacttaatgtcttccttagtaataaaccaactctctacaacaaagtgcttcctggctgcctaagtcattgattcattcagttcaacattttctcaatgcccaacagccaagtgtctcttgtatgccaagttctatgctgattatcagtatttgaataagagggggtctacatcttaagtactgcttaagatgaaagcctctaggttaacaaacttaacacaatgtatcattcactactaaatagaccgaatacaaaatcttgttattggagcccagagagaagaattgaaattcaagttttctctctctccttttctcactcaccacaataagtcagttgcaccaagtcttgtagctctttactgagccatgttttcacgtgtccctttgttttatttgccacaccctaaataaaaattgtactggctttttttccctgggtttacagtattaatacattgtcaagatttacctcttcgtgtagattccctggggaaaattacctttcctccttcccttaaattcttcagaggttagaaagccattagtaacattctggtatgtggacaaagtttacccattatgtatggatgttttactctttctatttttctgacaataatctcttaaggaggtgtggttatagaatagtcagctgttataagtactgttttcctggccttacaacttaagttctttaagctgtttcttagtttgctcatctcaaaattcggaataaggataaaacctatctcttagattgttggattaaatgaattaacatactggaagctcatgaaatgtgcctggcacacagtagtgcctaataaaccatctctcttattcagcctgttttctgatttcagaatctacacttgctgagccaggttcttttcatttcaaggtgagcaaaagcatacaaggaagagatggaggtaggaagagattaagccctaggccaaggtcacacaccgattgggagctggaatcaaaggcaatttggtcagtgaataaaaaggattccaaggcccataaggcaattctaaccttaggatcgaaattctcggacatacaggaaatgctggggggggaaaatccggtcttctcagcccaagagccatgtgaaaccagaccttcaaatctgatgattctcagcccagctgcccattagaatcgttgtaatttaaaaataccctcggaaaattctaatatgtggctatcaaaggtgatcatttgcttttatgccactttgttttcacccaaatgggacatccaacccttttcctttgagagtagttgtagggaaaggagggggtggagggagggaagagcggaaaaggctggatccgccctgagccggtgtcagtatctgggaagtgggaggcgcgtcagcagtaaacagcttctgctaggattattatctcctgccacacactcggatttgaaggctccaaacgaaacaatgcaaaacgcttcagtggagttccagaagcgttagactaaacgactgggtctgtttggccagtctgagcagctgggcgcagatgcataggcaagacttagcccgcctagacttttctgcccacttaattccgatcaaagcagaaaccggccgggcgcggtggctcacgcctgtaatcccagcactttggtaggcagaggctggcggatcacctgaggtcaggagttcgagaccagcccggctaacctggtgaaactccgtttctactggtggcgggcgcttgtaatcccatctactagggaggctgaggccggagagtcgtctgaacccgggaggcggagtttgtatgcagtgagccgagatcgcgccactgcattccagcttgggcaacaggagcaaaactccgtttcaaaaaagcaagcaaacaaacaaaaaaatgcagaaaccgagatccggaagaaaacctcggcgagattcacagaatccaggaaaataggtctctagaaatttgtccatggtcccagatctccatttcttgtgggtggggcagctgttaccagatccctagaagcaaaggtttttttgggggaccgtgtctcactgttgcccaggctggagggcagtggcacgatctcggcttactacaacctccgcctcccaggctcaagcgactctcctgcgtcagcttcaagagtagctgggattacaaggtatgtgccaccacgcccaacttatttttttatttattatttttatttagtagagaggtgtttcaccatgttggccaggttagtgtcgaagtcgtgacctcaggtgatcagccccctcggcctcccaaagtggtaggattagaggggtgagcagaaagcaaaggtttttgagtggccacaggccccactctatttccttttctgcctgtaatggcaacctagacgcttgagcttcttaaaatacaagagtaagttgcatgtcaggcaccgttctacattagggacattagtctgttttacagacacctttcaactccctggttaacttttaggtaatatactctgcactttagcaggaatgggacctataactctcacagaattaggaaagtgaggctgcctacagcctaaattgagaaaaaaatagacgggggactagtcggaggaccaaacaaggttaccaacacgttagagttttgccttcaatttacatttttaaagtaatcacaacgaagtgtttagatcacgaggcatccctgcatgtaaactgttaggcactaactatggtcgatcttacaaagcattaactagaatatttctttagagtatgatagtacgtaactgacctactattacatacaaacagaccaacctttagtaacagcgctccccaaaaaccgaaaagcagtaatacgctttgctcaaggttggcataaaattaacttaccttagtgccttttttccttctacctacaagcagtgaggttagctcttcctttgaaacggtaggggggctctgaaaagagcctttgggtttgatagcgtttccgggagctcagatacctgtcaaatcacttgcccttggccttgtggtgactctcggtcttcttaggcagaagcacggcctggatgttaggaaggacgccgccctgagcaatggtcacccggcctagcagtttgttgagctcctcgtcgttgcggatggccagctgcaagtggcgcgggatgatgcgagtcttcttgttgtcgcgagccgcgttgccggccagctccaggatctcggcggtcaggtactctaacaccgccgccaggtacaccggcgcgcctgccccaacccgctctgcgtagttgcctttacggagcaggcggtgcactcggcccaccgggaactggagaccagcgcgagaagagcgggatttcgctttggcgcgagctttgcctccttgcttaccacgtccagacattgcaatcagacaaaaatcaccaaaaccagcggcctaagctcacgagaaaacaaacaaaatcaagaaatatgtaaaacatggccgcttttataggtagttcctggggagtaaatccgactttttgattggtcggtagcaaatgctagtcagatagccaatagaaaagctgtactttcatacctcatttgcatagctctgcccacggatgacaactgtgcagtttgtcttccaattaactaagaggtactctccatccctcattagcataaaagccctataagtagcagaaatccgctctttactttcgacacatttctggtgttttaagatgcctgagccagccaagtctgctcccgccccgaagaagggctccaagaaggcagtgaccaaagcgcagaagaaagatggcaagaagcgcaagcgcagccgcaaggagagttactctgtgtacgtgtacaaggtgctgaaacaggtccatcccgacactggcatctcttccaaggccatgggcatcatgaattctttcgttaacgacatatttgagcgcatcgcgggcgaggcttcccgcctggcgcattacaacaagcgctcgaccatcacctccagggagatccagacggccgtgcgcctgctgcttcccggagagctggccaagcacgccgtgtcggagggcaccaaggccgtcaccaagtacaccagctccaagtaaacattccaagtaagcgtcttaacacctaaccccaaaggctcttttaagagccacccagatacccactaaaagagctgtggccagacgccaaattttatttggcggcggaggggtattagaatataggaactggagaggggtggggacaagtgttgcagcttagagagggacaaagggtcctgaacccgaaagaagccagccattaaaaatggctttggggtcaattcgttgtgcttaaatttaaaatggagacaagcggccattttgctaactcggcgttcccggaagaaaccgcaggctcgcttaggtttcagacccagctgtctgtccctgtctacgtcgccaggatcaacggttgccgtaatgtcataatttcgccaccagcttctagccaataggctgtcctgtcattttaaatattaaccaatcgagggaaagctgttttgagactctgatttacatagcggaccggagtgggaacctgggcagtaactgcctaaggaaggactccccctctgttttcgtggcgcacaccttcgtagtatactgaagggtgtgtctcctgggtttccaactgccccggtaatagtcttttaacctaatatgcgtcagttttgataacaacactaaggcagtacagaactaaagatgtaagcactgcgccagatgttgcttcatacatcttattctattcaactggtttattcaagattcaaatcaaatcaaattttgcttgaatcccagtgctcagtcagccataaatggtgtgttgcctgattgaaacttaaaatctccgtagggggcttgtaacatgcagacaagtttgaaagttgctttaggagaagccaactcttaactgctgggtaaattgacaagccttcgaacactgaactgaaggccagtaaggactaggcgctgggtgggggagaatgaagaggagacgtcattaaacttagcacatacactgtatctcctagaggactctcccttcctagacaactgcaggccgctttgtggcctgggaaattccacattcccttaagtattttactcatggtcttttccaggtaaagattttaagatgaagggttagacgtagtctacctatctttttattcaagtctagaacacgtttttagcacctagaagtttgctttctccattaaaaaccgggaatatacaataaataaaattagtgttaaagcagatttttacaaacttaaataccatgtaatttaggttacagttatttaacataaggactgtgtgatcttaaatctgcaatttctttcacacctgggaaataaactaaggcctgtctttggtgccagacaaggccttatacttgaacactgctgtgcaatcacaggctgccttgcctagataacttatctgagaaattctgatgagaaatgaaatttccagagtccctcacaagtaaatttttttttcttttttttttttttttttgagacgaagtttctctcttgtttcccaggctggagtgcaatggcgcgatcttggctcacagcaacctccgcctcccgggttcaagccattctcctgcctcagcctccggagtagctgggattacaggcatgcgccacgacaccctggctaattttgtatttttagtagagacgaggtttctccatgtcggtcaggctggtctcgaactccggacatcaggtgatctgcccgccttggcctcccaaagtcctggattacaggcttgagccaccgcgccgggcctaaatggttttttttttttctatgcctctaatggacctggtcacttattcccattcagactgaccgctctcctacctgccaactaactaatcagtgtaaccaaaatctgcaaacaaaattcagtattctttccccgccttttcccctttctcttacatagattatgtttttgcctgtgttagatgaaataattctattgcttgttctctcttctgtacaagtacccagtaagcaaattattaacttcttggtcatttatttctgaattttccaccaagacagtgtttatgtgagtcatacaataagaaccaacagaaatgtgtgtcttggaaacaggttgtctatccctggaccctttgagttttctgttcactttcctttggcttttgcatgctaaaagtttatcgtccgcgtttgtttgttttggttattctaattggacttggctgattggttgcatattggtggcagtagtagaatttgaattctggttttctggtcacatcattaagtgattagtcagtggagaggacaggaaatctggtttatttattaacctttttttggggtgtttttgtttgaagatgttgatattctctgtgaggacacagggttagagttggtgtttttctttctgactttacatgggatttgatgttttgtgcttgtatgcctctttccaccttccaaaacttgtcttttttgagtccaaatagttgtcgatatctgcaaaaccagtattcctgtgttaagatgatatgaatataaaatggctgccctgttataacttttgactttaagaaagtgttaggactaacaggagacaaaaaggaaatcaaggaaaccgaatgtctggtctcaataactgctatggcagaggctctacagcttattattaattttagtaatttcacattattgccccttcacgttctttaagtaaggttagaggacagaagaaacataatgttgttacaaattggactattgagtcagggaaaaaaaagagtgctttcaatatctgaataaaacaaagatttaatattttctaaaccttaacgagtttattgtaagggatgtgatgctggaaactaggaaactagaattttcttctaaactgagaatcagaattattcatattctcagcagtggtgccacctgagggacttctgatcttaattacatacttttatttctttaactgatcaacatgctaaatagataacctatggctctgtttttacccactttaaattctgttctattagcacggttagctttcctaattggcaataagattgagactatcttttttttttttttgagacagaattttgctctgtggcccaggctggggtgcagtggcacaatctcggctcactgcaacctctgcctccagggttctagcaattttcctgcctcagcctccccagtagctgggattacaggtgcaccaccacgcctggctaatttgtgcatttttagtagagatggggtttcgccatgttggccaaactggtctcgaactcaggtgatccacctcggcctcccaaagtgatgagattacaggcgtgagccaccgtgcccagaaaagactatcttattttatgaatttaaataattgtgaaattatccacttaagggaattaataaattataatgtaatcttaaattttagttggcttacataaagacttaaaatacatcaatttaaataaaaactcatttgtctaaaaaaaaatcaaaaattttccttgtgctttaaatgtgctacctctttaagttctaattaagagaaaaaaagtttaactgtgagtttcattagtggtcttagttaacagcttaaagtattttgtaaaaaaaatacttcacaatttttaaataacttaaaaatattaatacctcttttattaggtttttttaataaggaaaatatataatacatctaatcaagattttttttggacaaattggcttaataatttcattttaaaaatggcttctttattcttatactgtaaaaataatattagcagaatattatagtatacacaagtttagggttcatattctaaaaaacaaaaacaaaagctaatttaacttgcatttactaaatttcttccactagttgtactggttacatgagttaacatcactttatttattattctaaaattgtaaattattcattgaaccaaattaaatgataatagataatgtcatttttaaaaatggaattaaattttatgttactaattataaggattcaatgtgtgagcttaagtactgagttcacagtgtatgataactttaagaatttaggtgaatattattaaattgagtaaattaattctcaatctttggatacctggacaatttctaaattggagggtacaaaatacaaatcacaagaaacagtgtagttttatgcaaataacatttttacacagtttagaataaccattgataaacagataagagaacatatgattgccttagaatagatactgttgctttcgccactttagatttgtaaatcacgtactgtatacgtgtgggcgtagaggaccatgcaggttttggatgactgcctctgttttcgtcatgcctatgcgggaacacaattgcctgctttgtttaagggctatggttaatccaaacagctctgactctatcaagtactatagctacagagaaacacaagtaagcattcgagataatgactaccttgagcctttacttatttaaaaagttgttactgtttgttaatgtggtacattcaatttactatggattgtcactctaaaataagacttcaatctttttcttatttttatatagccatgatttatattcatatcttaatgtaataaccaatcttctctgacaacattataacaatgctggaacctccattttcagtacttcaaacaacaaatactgcttttatacttcagagcagatggatatgtgcttcccagtgtaaacacatttggaatctcactgagaaatacactatcactaaaaatacagttctgagattcattaaaagacctccagaattctggaagtaggaagtttcctcttcaaagtctacagaggaagatgaggtctgaaatagacagcttcttccttcttttacctgtggtattattctgttttgtccttttctccattatctgtctttccagtgatgaaattttgatctggccctcccaagtattaaaaaacaagcaaataaacaaatctcagttatattttactaagatattggcatgctaactttttgcaggtttgtaacaaggacctttataacttgactaaaagttcctaaataagaatatttactagaaaatttatttctgcctgtggcccacatttgagtcaaaataatcaattaggaaaaatgaacttgtttaactaaagttgaccaaactgatctttgaccaaactgatctttgagacctattcatctaagacaagccaattaaattcttggagacaatttgtactttaaggaattcttataatatttgtaattaccctcataacttttttttttgccctacttctgtgcttctctaatatgcagattattaaatgttgttacaaagccattgtcaaaaaaacaaaaaacaaaaaactaaacaaactcacatggttagacttgctcctttatgagatatttttaccaaaaatggaggagttgaaaaactctggtgccagaaatcgtgaagacatggcctacctaacatggaaatgttggttgtcagtggaaaatactacacagagatagccatagtgctgcacagccaatcttaagtgtttctagagaatcactaattgtttctagagaatcactaattgttttcttttaacattcttggtttatacaagaagagagtatccatactaaactcttttctactgaaaataatgtgcaaacataacatcctattcctagacagtttgtagtttttttctcccatttctattttataaatcatctttttaaaatactttgttgagtgaaatcagtccattgcttgatataccttgagcacaagtaaatagtatgccaaaaattaaatgtctttcagtcacagtttgacaaactcaactaccctgagcctatagagtggtaataattgccctactcataaagatggggtgaagattaaatgaaatagcacctatagaacactagttccagacgtggtatcatgctagtaaaatggctgcacagcactgctcaatgatgacaaaaagtgaagcttctggagacagactccaagtttgactcccagatcaccacatataagatgtgggactctgaggcaggtcatttaatctctctgtgcattagtatccttctctatacctttacagtgatggtaatagcacctaccttctagaagtatgtgaagattaaagatccttaatgcatataaaccactgtgtttactgctgtttgacaaattttatttataaccatctttacgctcctaaaaggacttgaagcagcttatgactgaagactttggtaggagttggccttctataaattataagaatttcataaattatttgatatgaaaatgccagttgatcatagtatgtttaccggggtccaacaggttgagaaaaaatacactttttttccctgaacatatgaaattagctctctaggcatattcctaaggacttaaagaatgataactatcatttctcttaaatcttccagatttggaaggatatatatattcagcacattgacagacaatcccagtagtcctaaattaaaagacattaaaaattagtgaaacttttcctacctttagcctgtgtaatcctggatgaccaagcataaaattaaattgagtagagtataccactgtaacatttcctgaaaggtattctaggctctgagtaatttctttggggtctgaagatcagtttgacatatcctcaagtatcatgagttcattataattaagaaaaagagagtaaatctggagaatgagccactttcttactactccttgacctcagttctttttttcagagacagggtctcactttgttgcccaggctgccaggctggagtgtagtggcgcaatcgcatctcattgtaacctccaccttctgggctgaagccatcctcctgcctcagcatcctgagtatctggaaccacagcaggtgcacaccaccatgccaagctaattttttaaaaagttttttgtagagatggggtcttactatgttgcccaggctggtctcaaactcctgggcttaagtgatcctcctgcctcagcctcccaaattgttgggattactagtgtgagtcactgtaccccgccccacttcagttctgaggaggaaaaaatatgtaataataatgggactttggtttgctgatttaaagattcatgtaaccttatcatccaatgcgcaatttgtagaataattaatagagacatctggtctcatgtttctacagttgctcatgccttgatagtagatctccttgctgctggctcagaagggtaaaagagcagaaatgatggggcttctctcattctatgaggaaatagacctatgtagaggaggctacctgtggtaaaaccttatcctcatcacttaaaattctaggcttattctctgaccatatcaagttttcaaatggtaaaagaattggattcaagagaaatatgaataaacttttgttttcacttttctccctcctctccccccattctcccttcctttattttcttgtccttagttttcttttcacttttttgtctactattatttgcccaaactcaactgtaggctagaacaaaaaaaaattgaaaattaaaatgtgccccttttgttgttagacttgcttaaacaattggggtaatgaaccttggacactagattttaaaacacacacatttgagcttcagtgcactgaaataaatatatttttaacaattaaaaaataaaattgcatgtttaaaaaatctgcagagaacaatacacgttgtgagatcttgaatggaaggaaaactgctagcctcaagagtggatcaaagatgctcagcaggcaacagagtaagagcatgttggagggtttagagagtgtgctcagggttctaggctctaaaaatcagacagtccccacggcctggccttcgtcgctgtatcttctttatgaaaaacactaagtctttttcctcactggataaatttttatccttcaagtttagatcaaatggaactttaggacactgactaggttacattcatcttttaagagcgtacagacattcaagggctagaggatgtgggtttactgcacaggctcattatccaacagctgtgctacctgggaaacttaacctctctgtgccttaatttcctcatctataacgcagggagaatgacagtaggtatctcataaggttgttggaacaactaaatgcattggtatctattgtgtaaagtgcttaaaacactgcctggcacagagcaaacatccagtgaactttagccatcatcattatcattgttctcagagtcaaatacaatatctcatatctgataaattacagaagtgaatcaatcactctctctcttttctccagggggagacaacagcttttagacatatcttttccaacagtcgtcactgctggacactgtttcatcttgcaaataaaccaatgaaaatgagtgatcctagaagaagataaatggaggtattttgaacaatcaaagaaggacaaatgaacacctggctgagaaaaattagctcttttttctatgcataaaactattaaaatattcttcatagaaatttatgacacaggaaacataaagacaaaattaaaataactcctagtatctcctattctttttatatgtatattatatatactcatattcatatatacatatatctcacatcatgtatcatatataaaataaatttaggtgtcatgatatatatttagataaatatacttagaaacttttttatggatgtataatttatggatatattgataattatgtatttgttattgactacttcaattgattcccatttttatgcattatattatagattatatagctcacacatctttgtacataaatctttgttcaaatattatttcctaaggatagacttcatgaagtggaaatactaaatcaaaagtgaaaaacattttctaaggttcttaacatatacattgccaaattgctattcaggatcataccaatttataatcccaaaataatatggaaattcctgttttatagcactcatatttacaataaattttaaaaatcactgttaacctaatagtccttcaaaagaaaaaaaaattgaaattacattattttaatgactctattagtgagggtcattcttcccatgtttcttgttagccatgaccctataagaaataaactgcactgcaaaatgataaacatgacatcaatcattacatgggaaggcactatataaagaataataccttaggttaaggccacataaatatttatcaggtgccttttctgcggaggactctgaagggatactaaactgcatttagctgcatgcaactgaaactacttttacctacattgtctcttataaacattataactactctttgagaaagtgtttactatggactgaattgtctccccatccccccaaattcatatattgaagccataaaccccaatatgactctattcctagacaggacttataagaggtaattaaggttaaatgaggtcattaggatgggttcctaactggataggattggtggccttataagaagaggaagattctgcacttggtcttccaaattaaataatttatttaaaagaaaaaaaaaaaagaggaagagagggagctctgcacatatactgaggaaaggctatgtgagctctcacagtgagaaggtagcactctacaagccagcaagagagccctcaacagaatccagccatgctataccctgctctgagacttccagcctccagaactgtgataaaattttgttgtttaaaccacacaatctatggtatttttttatggcagcccaagccaacaaagacagcatcattgctgtcacttacagacaagaaaactaagactaggagagagaaaagttaaacttgtccaaggtcacaaaagccagaaacaagtgaggtgagaagttgaccttgttctcctcaatccaaggccaggactcctccactccacatgtagatagccacctcacagtcaacagccaaatgtccacaccccagagtcagcattagaccaagatgtcttaccaggagacaaatgcctcatcttgaataaatatgatctaacaacttacccatgtaaaacattgaatctcatgagaaacaaaaatgcaaagtatgtagaaaactatgtttaccacttaactgacagtgataaaaagcttaatgatatccttatagtcttggaggggtttgtatatgtggtgaaacaggtgctcacgcactgctgatagactgtaaattggtcctagagagaaaaataaataaactggaaggagatatgctgtatgtttactttttttatggaaacatatgatatacctggaaattcgattgaccatgcatctatttcttcaatgggtatgcacagttgagctgttcccatgcaccaggcactgtaatgggacaactgcacatgacagtcaaaaatctcagtctcatgaagtcgacatgctcatggagaggtgctacccactaaactaatatttgtatatcaattatggatacattgggccacatttacagaaattcacttacagtgggttaccagaagggattttttttcttgattggcaagaaggctaggctgttttgttgggggctggcaggagctgtctaggctgcccaagtatgcaggtctcttctatcatcctgtgttaaccatcttccatgtatctttcaacctcatggtcatctgcagcatgtctaggggtcatatctatgttccatgcaggaaaaaagggtaaagggaaagggaagtaggcatgtaccattttaatgcacaccttggttttcagaaaatttaagaagaaagactttctgcttttctctgactattctgtattctggattacaacgcaacagaaacgtcaccttaaattctaatgtttttctctccttgctttcaaaaactgactcattaacctccacgtggcttggaaaaattatttcagtcatccagtaatgagctgttcatagaaatgttttggacatcaagtctgtgttgttagcattatacatgttaagcattgaataaaaaacaacatgatgtgggtaaatttctttacttacatataagtacttatatacttatagctgaaaagagaggttgaaatgtcaggtggaacagaaataagattacctagatgtttctcctatgggtgattttcagctatgctgatctttcttctgggtcaggtactcccagaacttcctaattaaatggtggccctgatcttagttcctctctcctcttagacattttccaggactacagaagatgtgcagtttataaatgagtagcagaaacctactgaacaaattattcaggctcatctgaacagagaggacaccttctctgctatactctctcagtgatttccctgccttggggtcaattattgtcttggacattgatttaagcacataataattgttgtcattgcttatgtttggatttcatctcccaaaatagatggtaaattctttagtttagagaccaagtaatacttaaaaaaaaattttgtgtgtgtgtgtgtgttttttctgtgtctctcagccctgtaatagcatcgtacttacacttgttagatttttagagacaacttttacaaaacatggaattatctacataccctttctacaaaacagacaaattaaatactcagtagttgaaccaaaaaaagcagttcaaataaaatacttgaaaatgaagaaatcatttgaacagagttaaagttaatcgtaaaataatgtctgtaaaaattattgccaatcaaatataaagttcaaaaatagtgcttgaaaaaggaagaatcatatgaaaagggactactcattttaaaaatgttagatatcaggaaaagccaagaagtgagtatggtaagagtgctgtcaagtgaaaccctgctaatctcactgaacatgtaaaaatctgtagatgcctttattttattcactcacacacatatgtagaaagagaaatatatggtaaacattaaaaaaaccaaattagaatgtaaaattaatactttaaaaaatgggctgtatacttttcttatcaccggagataagaatttattatttttaaaataaagttattttctctgtgactgtttccatgactttgctacttagaagttagagatgccaaagtttatctaagaaaatgtttatggaaatattatttcaataatgaatgtttagaagactgaatttcctgactgggcgcagtggctcatgcctgtaatcccagcactttgagaggctgaagaaggaggatcgcttgagtccgggagttcaagagcatcctgggcaacacagcgagaccctgcagcaaagtaaaaagaaaaaagaattgaaaaaggaagactgaatttcctttgggcaagtcatgtgacattcctgtgcctcagtttcttcatctataaagttaattcctacatttttggggaagggagagaaaaacttaggatagtgactggcacagaagaagcactatatactatatatatgtggatatcatttgtttttatggtaccattttagctatctaatgcaaaatatgaatcttttttttctgggtcttaaattatggaatgtaagaattttctaaattctctaattctgtgttagttttaaagcaatggagtaacgtatctgtcaacttgtaaatataaggatcaacctgatccacaatttgacccctagccactaatatttaatagtacaacactcagaaattatcaaaggtcagagaagccaaacaaatgtaaaaacatacaggtgctcagaaagatgcacctgtaatctctctaaggagaaatattttccaaactgagtgacacggtgctttagtgagttgtggaatcaatctcatgatttccaacctagtgttcttttaaaaatgaactagtccacagtagaatatactaaagtgctggtgcttaagatagtattgttttctggaaaaaaaaaaaaaattttttttttttgagacagggtctcgctcttgcccaggctgaagtgcagtggcacaatcatgctcactgcagccttgacctcctgggcccaagtgattctcccacctcagccttttgagtaactgggaccacaggtacgtgccaccacacccgggtaattttttaattgtagagacagggtcttgctatgtgcttaggctggccttgtgaactcctgggctctagtgatccactagcctcagcctcccaaatttatgggattataggcatgagccaccctacctggcctgttccctgaatttttttttctttcaggtgtttgtgcatatgtgtgtgtgtatgggtataacagagagacagagagaaagaaacttttctatctcactttgcaatcagaagtttgaagtcttatcttttggcttttgtttcagaaatatttcaaatgtagactctctcctttaccacactgtccccttaggcaaggtctttgccattcttctgagactattgcaacagactcccaacttctgactgtgggcccttctcaaaaatgattgtttatgcaataaatctaaacccaagacaactacaacaatacaacaaattctctgcttaaaaacttccaatgtctgccgggcgcggcggctcacgcatgtattcccagcactttggaggcagaggcgggcagatcacttgaggtggggagttcgagactagcctggccaacatgatgaaaccccatctctactaaaaatacaaaaaattagccaggcatggtggtgggcgcctataatcccagctaattgggaggctgaggcaggagaattgcctgaacctgggaggtggaggttgcactgagccaagatcacaccattgcactccagcctgggcaacaagagcaaaactctgtctcaaaccaaaccaaaacaaaacttctaatatctaccaaatgtttcacacaagtatttggggatcttcacaaatggcccttatggagttttcctttgctgagaccctatgctctggccacactaaactcattcagcatcccagaaaggcctcagcctttgtgagcaagctcttatctccaggcctctcacaaagacctgttccagtagaagctcaggggagcacactggacattattccaacaaccctttccccacagctatgcagccaaatctgccagctcagttaattaattaagcaattcagagatgagggtctgcccaggctggagtgcagtagctgcgacctcaagctcctgggctctaagtgatcctcttcagtctacccagaagctgggactgcaggcatgtgccaccacacccagctaatttttttttttttcagtagggaccaggccaacctagtcttgaactcctggcctccagccttccgaagtgctgtaattacaggcatgaatcactgcgcccagccaacccgcccagtcttgttagacatggggtctgtagtttctagtaggttcttgagtctagggttcctacctcatgttttatagttaatttaggggagggactgtgtctgtttatctggggatgtaggggtgggcagggggatagaggggacttcaattaatgaaaccagaagcaaaactcagttgaggacaccggtcatgagagtggcctgattatggccaatcttacataatgtgtgagatcttgatattaccccatccttgagagtcctctataaagctacagggacttgggagcacctttaattacagacaacccatgttcctgtggattatgatttattagattgcacatgcctaaataaagacatcctctgcagtcttttgacaattctataagcatcttctgactccgcaattagacagctaagagatctgtgttacttccctcacatatataaataattttaaataaaaatcatggcgtgaataatttctttcctctaccgatttgaagctatccatttggaagaccactctgaagagatgaaataagtcttctgccaaagattacttattaatttacaaggaaaaggggaagttttgttcctctccgtgaatttgattgaaaatcgagggctttctcgaatagttttggcatccagggtcatttttcattaaaaagagaaaagtcatgtcaaatatgaatttccgcagattattcagcactagaccctgggagattctgtaaagaggggttttgttatactcaacttttccgggtaaaacaaacacaaatactcctcctccaaggggcgggggcggtgcctaggtgatgcaccaatcacagcgcgccctaccctatataaggccccgaggccgcccgggtgtttcatgcttttcgctggttattacatcttgcgtttctctgttgttatgtctgaaaccgtgcctgcagcttctgccagtgctggtgtagccgctatggagaaacttccaaccaagaagcgagggaggaagccggctggcttgataagtgcaagtcgcaaagtgccgaacctctctgtgtccaagttgatcaccgaggccctttcagtgtcacaggaacgagtaggtatgtctttggttgcgctcaagaaggcattggccgctgctggctacgacgtagagaagaataacagccgcatcaaactgtccctcaagagcttagtgaacaagggaatcctggtgcaaaccaggggtactggtgcttccggttcctttaagcttagtaagaaggtgattcctaaatctaccagaagcaaggctaaaaagtcagtttctgccaagaccaagaagctggttttatccagggactccaagtcaccaaagactgctaaaaccaataagagagccaagaagccgagagcgacaactcctaaaactgttaggagcgggagaaaggctaaaggagccaagggtaagcaacagcagaagagcccagtgaaggcaagggcttcgaagtcaaaattgacccaacatcatgaagttaatgttagaaaggccacatctaagaagtaaagagctttccgggaggccaatttggaaagaacccaaaggctcttttaagagccacccacattattttaagatggcgtaacactggaaacaagtttctgtgacagttatctataggtttaagttgtgatgcagctgagttgaaaaggcttgagattggagaattaattcaggccaggcttcaagaccatcctgggcaacatagccagactaccatctataccaggggtcctcatttccccggccaccgaccggtaaccggtccctgtccatggcacgttatgaattgagccgcacagctgaggggtgagcgaacattaaccaactgagctccaccgcctgtcaggttagctgcagcattagatagattctcataagctcaaactgtattgtgaatggcacatgcaagggatctaggtttcaggctccttgtgacaatctaatgcctgatgatctgaggttggagcagttttagtccggaaatcattgctcccagcccctgcaccccctggtccgtggtataattgtcttacacaaaacggtctcttgtgtcaaaaaggttggagactactggttttacaaaaaagtaaattagtcaagcatggttggcacgctcccttagtccctgcacccaggcgtttaaggatacagtgagctatgatggtgctacctcactccagcctgggtgacagcgagtcagacgttgtctcaaaacttaaaaaaaaaaaaagttaaaacagaaaaagggcttcttgtcagagactgccgtatatctagaggtccaggaactaaaaagtctgatgtccaatcctgaaaagctcgatggtgcactagaggaggcttttacatgtaagagcatctaagttctggaaatgccagtgtcagggaagggaagtggagagcaatttggcatccaaacataacttgctgatactttttttttttttaacacaagtactacattctagtctttctgtggtgtcattgtaactattgtttcttaatatgctatccactgacttcaagggatcaataaataggaatcaaggtgtcccagaatatggattaggggagtttttttgttgttgttgttgttgttgtttttcatctattcattatcctgtagctgaaatttagaattttcttccattgtgtgtgactgatagaaataacaaatttgtaggttatagttgttgcaagaatctggaaatcgtgcttgcttatttccgaagtactattaggtatatcaacaaaaacacacatattacggtcaagtggtttgataattattttaatattattggtctaatacaattgtaaccctatgaattactttaagtatcttatttatgaaaagaatctgtaagtttcatcagactaccagagcataccgaagactgaaaaattttaagaatccaaaccttaatggaaatgttggaggctgcccaattaggttctgaattccaccttcctgaatcacaaacttgttttaactctcagtctgaggtaaactacgtttctctttaaacagacatagtttaattttcctttgatttttgatttagtattcttactgatcatcataaataaccaatgctaatgttagtctactttggaccatggtatttcgagaaactttgaacaaagtcccctgcaaaactatgcattgcattatttcacatacatttatgttttccagacggttcaatagtacctcacttttctgaacttatttgtatagtttggcatctttttaaaaattgtgtcctataatgaaaggttgtaaacattatgttttaaatttgtatagataaaatcaaccacagacctttccttgcttggatgtaattgccattgtttcccaatgagttcggaattactaggattgtgcaaaaatatgcctcacttgcctgacatagcagagagccattttgcctaaatgctgtgcccagcaatggactgtcaccagattctcatcacatacagtgaggatgaacaactagcctctcccagcagctggccggtctctcaataatatgggactccctcaagatggcttcctgcacctttgctcctctagccttgtatgtatacaaggctagcatgcctggcatacataaggttaaaaacaaaatcaataagttatggttcttcctccagttctggggattattagaccacttttttgttttgttttgttttggatggagcctcgctctgtcacccaggctagagtgcagtggcacaatctcggttcactgcaacctctgcctcctgggttcaagcagttctctggctcagcctcccacgtagctgggattacaggtgcccgccaccacgcccggctaatttttgtatttttagtagacggggtttcaccatcttggccaggctggtcttgaacgccagacctcgtgatccacccaccttggcctaccaaactgctgggaatacaggcgtgagccaccgcgcccggacttagaccactttgttttggccaataggacaacagccatagaaccctccgcaaatgagagcttgtccctaaagatgctttatttacatagctgtgtgccgcatgagccaaaaggtgataacctttgttcaacacgcgcctccagcccttcggttaagtccaaagtaccattcttagaatgctctaaaatacataatttttttttttttttttttttttttttttgaggagtctctctctgtctcccaggctggaggggagtggcgcgatctcggctcactgcaatctctgcttccgggctagctgggcctacaggtgcagaccaccacgcccggctaagttttgtattttttttggtagagggggtttcaccattttggccaggctggtctcggattcttgatctcaagtgatacactagctttggcctcccaaagtgctgggattacagtcgtgagccactgcgcccagcaaaatgctttttgtggagccaatcactttattagcgcttacctctctatgcctactttatgctttgaaattttgtcacagtgtggccggtcatggcaaacacaattcattcttatgcaggatgtcacggttatttctgtcatccaaactcattctcgcaacgcatttcagctctttaaacgactttgtgagcggccctgaaaagggcctttgggtttttttgtttttgttttttgaagttctcaggagaccgcgtattcttagattcagccgccgaagccatacagagtgcgcccctgacgttttagggcatatactacatccatggctgtgacagttttgcgcttggcgtgctccgtataggtgacggcgtctcgaataacgttctctaagaaaaccttaagcacacctcgagtctcctcatagataagaccggaaatgcgcttgacgccaccgcgccgagccaaacggcgaatagccggttttgtaatgccctggatgttatcccggagcaccttacgatggcgcttagcaccacccttccccaagccttttccgcctttgccgcgaccagacatgattcctatcgcagtggaaggtatgaactgaaacagttccttaaatacaaacttggcggacctgattgaaaacaacatgagttggcgcggttttttttttttttcaaatttggtcaccaagtgggtggagcaagaaaaactgtttcattatggttcattgttttgattggccagtgacagcttgctctttgtgggagtggaagggtgtttgcaagttgaatgcgctgtattcctgtcagcttaatgacgctaagcatagccccattccacatttctttttatttccacttgctaactaataaattacggaatagtttattggggaacatacaaataatgtttaaaggaggtcagatttataggtcaagggatttaccctcccaatcattttaatatttttatttaaaccaggcattttgatggccttctctgtgctggacaaggtataagtttggctatgaagtttcactcctaaagaccctatgttttgggaaggcaaaaaggtagccaaataattgcaaattaaaacctcataagtgcaaacttcttcctcgtcactttccctatctcgattcaaatatttgttgaatgactcatttttctgcaaaagtctgagagagacagggaatataaacttaagtctggataatatgttttcccgggacgctcttcctggtctgctgtgcctgtttgctgtgcctgaaattccaaacactcttcccttccctccgtttttaatcccctttcaacttgctacagctttagagaaaagaacattcgttttgtacagttggggattaattgaagtgtagggctaatacttgattaaggtcattacaaaatctacagggtcttcctctgggaggtttttgtgataagattattggtgttaaaataaggctaatccccttgaaaaataaatagaatagcagaattgggtctgaatgtggtttgaagaaagggacttctcaattcaaaattttattcttagcttcctgcgggagctttccagaatgcccataagatccacttttgtttaaaaaacaaaaacaaccccacccaccactctctggttaataaatgaatttctattgggaatatttagaatggggctgtggcctgtgagagacattatatagtaacctcagacttgctcacatgaagagaagaaatccaggaatggagaaaaaagacccaggaaaggccagaatgctctacatgtcatattgtttgtatcacttctgaaataattgattacattcttctgccccaaattgagttcttaggttcttccactcactgtccacatgccacaacacagaccttataactagagacttagctaggaagaaatgtcaaacattacagagaaaaaatgcagagtctgagatcataagtaaaactctgaaatctcaacatgccttttaattcatgaaaataaaaaatatagcagcatatgcaatatgacaattctctgaaaacatacatcatgtgaactaccctggaacacatctcgccaagtgccatcttcattttaaccagaggtctaggatgcctttcctttattttgcctattatatcatttataaaaccccatttttattttgatattttatttactttctatttcctgctcctaatatctcctttctaaacttttctcaatgacagtgactcaaaaacaatgaatgtcagaacaaatatttaaaggatctgtacatgtagatatatatatttaaaatggattcttccactctgcgaagaattcaggcatactcaatcttatggttagggagagattaggctcactcgcctaatctgtatggcttctcgttcgctttccatttcaccttcctctcacccatcagatcaaactcattcattgaacaagagacctaagcccttcagattaaaactctgcaaacaagttgtggttgagaggatacatgaagcattcaaacaaataaatctatgatattaatcagaggttaatctatgatattaatcagaggttaatgcagtggctcacggctgtaatcccagcacttcaggaggctgagttgggagaatcgcttgagctcaggagttcaagaccattttgggcaacatagcaagtcttcatctctacttaaaaaaaaataaccagaggtgttatgaaaatataaattgtccagaactaccctccacaaactaactctctcagaatattcgatatgaggaatgaaatatggtgtgtgtgtgtgtgtgtgtgtgtgtatgtgtgtgtgtgtgtgtgtgtatgcacctatatatggcacctatatattcaacaaacaattctgataattggccagggttgagaatgactagcagcccagcatacactatcagttttaagtatataattgcgctttagtaaaatgtaaagaaatcccagagtagaaatacttttaagctatattacaggtgagaaaatgcataagtatagtctcacccaacttagactatgggggctttataatgtcacaacagttgtttccaggcatttggggacatcaccactggtcttgggcaagaaactcctctagccaatggctgatttatctcactcccatctaaggcttcactgcatttctctttttcagcaacctaacttatttaaaaatatccattttctgattcatttttttctgaattaaactgtcagtaccattggcacacctttggttccgtagcatacctgtgtctctgctgtgttttttttttacctccactccttacttttctagaaaaaaatctctgctttttcttttcagtttaaattatttcacaaaaagttttcttgacttgcacttcctaggcttgctgtccttgtgtgggcacgctcccataaacactattaatacacttcgatttgttaaaaataaagatatctggacagaaaatttcttttctttttttaagattttaaaatttttaatgtttatttttttcctagactggagtacagtggcaccatgatggctcatggtagcctacacttccccgggctcaagtgatcctcccacctcagcctcccaagtagctgggactacaggtgtgcacaaccacacctgactaattttgtttatttgtttgttttgttttttgagatggagtttcgctcttgttgcccaggctggagtgcaatggcgggatctcggctcaccgcaacctctacctcccaggttcaagcaattctcctgcctcagcctcccgagtagctgggattacaggcatgcatcaccacgcccagctaattttgtatttttagtagagacggggtttctccatgttgaggctggtctggaactcctgacctcaggtgatctgcccgcctcggcctcccaaagtgctgggattacaggcgtgagccaccacgctcggccactaattttgtatattttgtagagatgggctttccctgtgttgtccaggctggtcttgaattcctgggcttaagtgatctgcccaccttgtcctcccaaaatgctaggattactggcgtgagccaccaggtctggctggaaagataatttctaacattatcctctcttaaacatttgtttcaaaaattttacaaacatgagagtaattaaatttgattttcaaaattcccttgaatactttcttaatagcacacagaaagcacaaagtattttacatttgttttaatgatgaaattgtgaacccaaacttacacaaagaaaaacccgtaacattatacccatacttaaaacagatgccctcatatacatagtaaaactcttgggggcagtagtgaagttggttatttactgttttatgaaagtgccattcagccgggtgcagtggctcatgactgtaatcccagcactttgggaggtcgaggcaggctgatcacgaggtcaggagttcaagaccagcctgaccaaaatgatgaaaccctgtctctactaaaaatacaaacattagctgggcgtggtggtgtgtgcctgtagtcccagctactcaggaggctggggcaggagaatcgcttgaacctgggaggcggagattgcagtgagccgagatcgcaccaccgcactccagcctgggagacagggcgagctccgtctcgaaaaaaaaaaacaaaaaagtgccgtcatagtgactcagttttaaggaataaatcaaggatatttaactcaatagactacagttagctaacgtgacttgcactgaaagttatacgaatattggtacttattcccctgcccctgaagtatgaattaaagactccaaaattctttttagaatcttcagagtaaaagctagaatttgatttttttaaataataaaaaaatactttgtatctaaatctggtgtataaaataacttggtggatgatgcttcaaggctatccatccccaaatttctccctgaatgataaagagaataaatgaatatgtcaattcaaaagttagaaatttggccgggcacggtggctcactcctgataatcctttcggacgctgaggtgggtggatcgcatgagctccggagttcaagaccaacctgggcaacatagccagaacccgtttcaataaataatagaaaaaaatgagccaggcgtggtggtcccagctactcagtaggctgaggtgggaggatcacttgagctcaggaggtcgagactgcagtgagccgtgatcgcagtactgcacaccagccttggtgtcagactgagaccctgtctcaacaacaacaaaacaagttagaaatttggctgggcgcggtagctcacgcctgtaatcccagcactttgggaggccaaaaagggcggatcatttgaggtcaggagttcgagaccagcctggccaacatggtgaaactccatctctactaaaaatacaaaaaaaattagccgtgcatggtggcatgcgcctgtagtctcagccacttgggaggctgaggcaggaaaattgcttgaacccaggaggcagaggttgcagtgagccgagatcatgccactgcattccagcctgggtgatagagtgagactccatctcgagaaaaaaaaaaaaattctgtatgaactgaacaaaatatccttaaattttaaaatacatctgaaagatatttcaaaatatttaggaaaaaaattatagggatcaggcaaattctgagattcctttttccctgcagcaaacattaggagtgctgctgttcctaaaaacatggtaactgttgccacaccgtatgtttccttggctcagacataaggttgtgtagttgttattccagaatagctagaataaaaatccagcacatcattttcttcagcaagttaactaacctctctgtgccttggtttcataacagcaacataagcataacagaatagcagcaatagctcctacctacctcataagattctttggaggaattaaattaagattcagaacacagcctaatatctagtaagtaataataattggctaaaaaaattttcttaagattatatatattcatggggtacaagtacaattttgctacattaatatattgcattgtggtgaaatcagggccttcaatccatcccggaaaaaaaaagtttttgaaaagatttctgccatggaaaacttttaatgtacaaattcatccatccaagaaatagaaaatatataagtatcaactccaaatccaccatatctatctcttctacaccttaaacaattactcagaaatagaatgcttgagataccagaatgcatgcatatcaagtaataaatgcatgcaggatgtcaacgcatcctaggctttcaaataaaattgtcatacaaaatactttaatattgtagtaacattctacatgttagagtgtagaagttaatcgctgatgcaaaaaaggaaaagaacacattatacccaaagcctacagagagaatcacaattacaaatatcagcctgcatgtgaaaatctttaatttgaaagtcagaaatatttaaatgatagtcattgttaaatcagattgtggtttgaaaaaaagttagtttaaaactgagtttatgaaaaatttggggattttagagacagtgttttgtttttaaatgtgtgtgagtttgtgaagaatgttttataaaatactgacagtattataagatgacattattataatacaacataagaattttggcctgtacctctcagcagtcctcaatcacctgctgtacttgactcaatgattatcagagtggtttgttttccttctgttgtgttcccagttcaggcagctcagcaatggcctgtgattccagcaattcaaatagctggtaagtagtttcttgtttgttttctcaaattttcaggggcttttctctacaagtgatttccagtgcacgcccctccacccattctttattcctttaccttcaggaaaaccctcagcgctgcatctctggtcaccggaccaccgtggtacatttacctatggccaccaggtgtcacccttctctttactaccatggtttgtgaatggttttgccagaggtgaataagaatttaaaatgcaggtctttgatttttcaaatgtagttgaccttaagaatttatgaataaagccagaaaaattaagcttaaaaaacaccgaaagaaaatgaggacttaaaatttctattaaaaaaattaacaggccacagttgctgatgtttagtaaatgtgttagtgaaatgtgttactgtgaagactggggtgtttcttgaaatctcagcccaggtgaaataaaaccaatataaaacaaatgcttacctaataaattaattgtaacatattccttatgaggtagaagagtaagtgaagccttatagcagtctgctttcagtatagtaagatattaagagagaaataatttgtcatatgctttcagaatggtttgctggtaaaataaccaatgtcttacaacttagacgacaatgtccctagagtgaagaaacacgattaattcggctaccacagttgaatgaaaatattccgtaagacaaaatgtaaagaaattagaagcaaaataaatgtctccaaaatgacaaagcgattaagtatatacacaagatgaacaagaacttcaataaaatcatgcagtatacaatacaatatacatttattaaagtatatgcatttttaatgcaacaataatactaacaggtaatagacaagttgttaatagtttttcactggctaattaaataacagctttaattgtattcattttatagcttttctacaatgagcgtaaatcacatttacttttttctacataacttttctaaccacaaaaaaagaaaatggtttaaaagaagagatgagatatctttgctaaaatttaatgcctaaagaagaaacttctgagctgtatatggtatcctgaagcacctgcccttcaagacagaatgcttgtaccacatttatgcagccaagtgcatgtagtaacataaagtaaacacatgccatctggatatatatattaagactcttttgacggctgggcagggtggctcacacctgtaatctcagcactttgggaggccgaggcaggcggatcacgaggtcaggagagttcgagaccagcctggccaacatggtgaaaccctgtctctactaaaaatacaaaaattagccgggcatggtggtgcacgcctgtaatcccagctacttgggaggctgagacaggagaatcgcttgaacctgggaggcagaggttacagtgagccgagatcatgccattgcactccagcctgggcaatagagtctcaaaaaaaaaaaaaagactcttttgaacatggtgaactgatttcccagaatctagcaattcctgaatgtcctggttagattttttttttaatgtgcaccggaaccccagtggctccatggaaggacctgggcatcctctaagccacttggtggcttccattataccatctcaaaatgagagagcttactccacttcattgagggaaataccaccagagttctgactccagaggcactggcctagggaggacaccgtgtgtgaagcccagcagggccactagctgtccccaccaattacagtccttgcgtagggtccaaagaaatgaatgccaaagagagcaacagaggagcaagggagtcacattccaggaccttccttcagggacttttaaaggaaacatgacagctgaggatcagttggttgttttctgctgttccccttcatgtgattcaagctcactcagaagaaacacaatgagacaagagaagagccatctccttccttctctatttattctaggcatctaaactactgaatgtagtggtgtctgagatgtatcaaacggtcagattgactgagtttgaaacctgtttctatcactgacaaactatgagatactctatacttcactttcttttttttttcatttttttatttttatttttatttttttgagatggagtctcactctgtcacctaggctggagtgcagtggcgcaaactcggctcactgcaagctctgcctcctgggttcatgccattctcctgcctcagccttccgagtagctgggactacaggcgtctgccaccacgcccagctaattttttgtatttttattagagatggggtttcaccatgttagccaggatggtctcgatctcctgacctcgtgatccacccgctttggcctcccaaagtgctgggattacaggcgtgagccaccgtgcccggcctacttcactttcttcatttaaaaaagaaatggggataatagtacctatctcatagaattattgtaagaagtgcatgcagtaatgcatgtaagtaggtgctcagaagagtcggacacgaagtaagtgcttttatcatccttatcataattttcattatcagaacaaggagagaccaggtagaaaattattgtgattcttcaggtctggaatactagagtagcatcccaaatgaaggcaccattaaactttgcaaatctgtatgacaccttcatgccaattagaaaaaacacctcttcacaacccctttcaagatatttgcctcctacctgctaaaaacacccatcatactacccacagatagccatgatgctttttctgggacaggtgcctcttccattcgtgcagtgtacagccttcatagctgtgcaactcacatcacaatcagatggaagaatccccaaggcttggtgacagatgagttactgggtaacacagagagaggattcaaaggaaaagttgaacgggtccagaaaatgcatagatacatgtgtaaaaatctggtaaggttatgactagccacgtcccagggttcaaagcttttctcagatgttaaaatgaatcatgtaagtcccccaaatttaaggagtcctcttccaaaaataggaaatgaaatgacataggtgtatgtctctgaggtgacggaggaaatgaaggaagcctctagatgcagcttgaggttcatgagagacagttccaggggagaggtcacagctagggatcaccggcatgcaggaactcagaaacctaaatggggaaatctttttgaggaaatgaacagagaaggctaaaatcaaggagttcgtcaggcaatttctatgtttaggttcaactctctcctgaaacatgaagagctcataaatgcactccctctttgagtctctagttttgtctccttcccacagtgagtctgcaggctgcgtgtcactcacgttcagctaagacgtagtgccccatggctcctcctgtggagacaagagacccaggaaagaggcatcacaaacctaggcaccatcttgcctcttctctcttccttattttcctcattcacccatctcaatttagacctgggcactattggatttcaagaaccattatctctcatctggaaatgcttattggctttctaactggtctcctcacctctcatctaacttcttaacaacacattcaccatataagggagatcgtggtcctcctttcttaggatccttcaatgacaccccagtgatcataacccaatatcccaaaagacccttggactctgtatgagctggcttctttctgattctcttttccctacaccacagatgttcagggggtagaaatgcataattggtgagtgatagctacgcaaactcagggttaaggtacagtaattatttctaatctcccagtatgccttatactctcctacttggcatggttgctccgtctgtgtagacctcccatcatcttcaacctcacctaatggaatccagcttctccttcaagatccagaaggctatcttgatccccagctgaatgtgatcattctttcctttgacaccctaagcatttgcttcctgcctgctttaggacctcatggggtcttctttaactacatttacttgctatcaatttcattccctaccagatttgggttctgagaatagccacagtgacttctcaacctcaaagcccctgtactaccttaaacagctcttgcaaaatagtaggtgctctgaagatgtttgttgaattagagactttcattctggggagaaccattattttctgtctcccagggagctgctggtgtccccaaagaatataaatgagaaaaatgcttcccatggatgccagatcccctctgcccctcttcccactgtgccctggggcagaggtactaagagacttcccccttgttcctactcacttgaaccctgcctcttccttaatattatgaacaaaattccaatgaacaagatgacgacaaaaacagcaattccactgatgactccaatgactagggtgccagacggtgagggctctaaaacagaaaaagcaagttaaagcctttgattgccaccctcagcccaccccctaacaaagagcagatcctcatctcactgccataattacctcctcaggcactcctctcaacccccaatagattttctcagctcctggctctcatcagtcacataccccagatcacaatgaggggctgatccaggcctgggtgctccacctggcacgtatatctctgctcttccccagggggtacagccaaggttatccagccctggtaggtcccatccccattgggcaatacgtctttaggttcgaactccttggcatccattggctgcttatccttcagccacttcatggtgatgttctgggggtagtagttcaaggcccgacaccgtagagtggtcactgaagaggtcacatgatgtgtcaccttcaccaaaggaggcacttgacaggaaagaggaaggatgaggagaggggatctgtttacccttgccaggaagactggaactttcacttccttctataggttggaggaaggaaatacccttttcagaaaaaaacaagctacaggagagacaccattttgtgtcctaagattggactctaacacagtgtcacttggagagcagtcagatcagcttgttctcctcacatgtaaatatacatatctgttacccatgttctttgttctgatagataaaattgccctttatgtgcattgaaaatgattgaatacagatggtcagtttcacctgggtcaacctaggaggcattgttataagaagcggacttgtaagataggtagcttcagtgattattgctatgttctatgaaagaaacttttaacctaaaggattcttctactctgataagtggcctcacttgatattttgtcctggtattcatatgatagctgagatctctgaattctctttttttttttttttttttttttaagatggagtctcactctgctgcctaggctggagtgcagtggcgcgatcttggctcagtgcaacttccgcttcccaggttcaagcgatgctcctgcctcagccttccaattagctgggactacaggtgcgcatgactgtgaccagctaatttttgtatttttttagagacgggtttcaccatgttggtcaggctggtctcaaactcctgaccttgtgaccacccgcctcggcctcccaaagtgctgggattacaggggtgagccaccgtgcccggccttgacatttctgaatttttaacaggtataaatatacaaaagattattggttaaataaaaagcaagggccatagacacttccctttgagccatatgcatggagaaaagaaattaaacccatgacttgtggctgtctcatacatctcaattataaggtagagactctaggattgagaaagtcccttcccagaatttggagaggcacacagcctcagccacctctgaaactccaaccagggattccgtgccctgcaacctcctccactctgccactagagtataggggcagaagtgtgtttccaccataccttgttggtccaaaacacctctccccagctccagcaactgctgcagctgtgcagggcagtccctctccaggtaggccctgttctgcctggcccgaatcttgtgcctttcccactccagcttggtgggccaggccctgggttctgctgctctccaatccagtgtgtcagggcagaattcaaggtggtcctgcccatcatacccgtacttccagtagccctcggtactgttgtcttcttgcatttcacagcccaggatgacctgcagggtgtgggactctggaaaaatccccagccttgttaactgcaaccaaaggaataggtccctatttccaccatccccaaggaccaaatgatctcaggaagcaaattccttccctcttccctgctcccacaagacctcagacttccagctgtttccttcaagatgcatgaaaagatgaaaagctctgacaacctcaggaaggtgaggccccctctccacatacccttgctgtggttgtgattttccataatagtccagaagtcaacagtgaacatgtgatcccaccctttcagactctgactcagctgcagccacatctggcttgaaattctactggaaacccatggagttcggggctccacacggcgactctcatgatcatagaacacgaacagctggtcatccacgtagcccaaagcttcaaacaaggaaagaccaaggtcctgctctgaggcacccatgaagaggtagtgcagagagtgtgaacctggagacagagcaacaggccttaaccatgtgtagtaggaggggagcaggatgttgaggctccacacacctgcatcaactcataccatcagctgtgtctggtcctcattttgtgaagggtgagttgcagtcctgtctttcttccatatgacagtcctgggtgctctttccttgtgtgcttttctctgccacacgtggctgccaccccctcactgcccccagatcctattccaatactcatgattagacagactccactaaagctggtggattctagaaaatgttaaggtgtgtctagccatggtagttgaactcaggagttggtgctcagggcaaattagacccaaatcctgaggaataattccttcagtttttttttttttttttttttttttttttgagacagagtctcactctatcacccaggctggagtgcagtggcacaatctcagctcactgcaacctgcacctcctgggttcaagggattctcctacctaagcctcctgaaaacctgggactataggcgtgcgccaccacaccaggctaatttttgtatttttagtagacatggggtttcaccatgttggccaagcttgtctcaaactcctgacctcaaatgatctacctgcctcagccaccaaagtgctgggattacagaagtgagccaccgtgcccagccttggtcctgaattcttacactgaactgcctatgtggcctcaccacttggaagcctgactggaatctcaaacttaacatgtccaaatgcagatccttgatttaccccaaactgctctttcctctgccttcaccatctcagaaatggcattgccaattaccccactgctcaggccaataaaattaaaataaagaacaaagtcaactttaactcttctctttttcagggggtcaggggagacagggtcttgctctgtcacctaggctgaagtacagtggcacagtcatggctcactgcagcctcaacttcctgggctcaagcaataccctccacctcagcctcccgagtagctaggatcacaggtgcatgccaccacacccagctaatttttgtattttttgtagagaaggggttttgctgtgttgcccaggctggtcttgaactcctgagctcaggaatctgctctccttggcctcctccttggcatgagctactacacccagccaattcttctctttctctcacacaacatagaatccttcagcaacttccttcagaatatattcaggagacaatggtttgtcactcccttttctgttcccacccagcccactccactacctcttgcctggactgtgtaacagcttcctggctgggctccctgcttttactgttgctcccttcattctgctttccacatagcagccagagcaatcttttaaaagcctgtgacagatcactgttactccttggctagaattcacaccacagcctacaggcgcctgcacaaccttgtttgtggctcctcttctgagcccattacctacttcttggcctctactccccagcactacttgtttatttttttcaacccgagcttcttaaccaggagtttgtctactaggtgacatgtggcaaagtttagagacatttttggttgtcaagactgggggagtgctcctagcacctagtgagtagggaggacaggatactgctagacatcctacatgcagatggtagtcccccttcccacccccacgccgccccccccccccacacacacacacatgagtagtgctgagaaaacccgctttttaatccaacttgccaggcccactcagtttgcctgggaaatactgctcccagtcaatatcattcttatttccttcatgtctctgctcaagtgtcagccccagagtgacttgccctgacttctctgcttctcacaacacccatgatttcctgatgttgtatatctttctgctcatttgcttattgtcatctctcccactagaatgcaaaatatcaaagggtaaagacttgtttccctgctctctcccttggggcttgaacagtgcaacacatggctgggactcatttacacttgtaaacaatgaatatttctgctcaacatgaaattttattattcaacctctaatgcagtgtgatgtttaagaatcatagctatgaagtggagacatgagctctgccaccaaagcccagtgtaccattgaataaatttgccaggaagcaggccgtgccatgcctcattcttgtcatgtgtaaaatgtggatacacgtagtaccaaaactcaaagtgctgtgctgaggccggcgtgtgacccacagaacactgtgctacactacagggcaaaatcactgtcaactaagattagaagcagctgtagtacttgaaataacatcagaaaaccagattatttatgttctttgtaacctgaaaagagttatataatctgaattccagttaacttctagtaaaataaacgtattattagctcctacctccctatgcctagtgaaaatcaaataagatcagatatgaatgtaacttagaagtgagtgcattgcttacatgttcattatcagtactttgtagagaggcctcttaattacacagcacattgcaaatcaataaagcctagccgaaaagagaattgttcagttcaaacgttcaaaactaacatatacttaattttccaggcaaaagaacaattgccaagagtggggaaaggcccgaggtaggcctctctcaggagcctcccaccctagagacctccaccccaggtctcaccaaaagtgggtggaatggtgaagaattcagatccccaacgccactctttcgcgcccccaccgcccaacgcattcgttctgaggtggaaaccccgtgcggatcctgctgtgggtttgctcagccttctcggcaagcactcagggaagaacttcctgtttggagatgactggggaaaaaactgcacagctgacattggaaataaacccgagttccaggttcaaggagccccaggcttagctcagctcaagtgaggaactacgagatttatttaaaagcattctagttgggggaagggagtgggcggttccaaaagtcactccgcagagccgggacagccgggggagggggcaggtcctggggcgagggacccctatctgcagttcagtggtaggcactccctcacggggtctggacgcagaaagtagggagaggggcttgcggatagggttgagcaggtcctccaaagttagcaaactcccaagcgcaaagaaaaagctagtttcgatttttccacccccgccgcgcccctagttcgcccgcagccctcggactcacgcagcaagcgcccctgcaggaccgcggtctgcaaaagcatcaggaggagaagcgccggcctggctcgcgggcccatttccccagctctggccgcacgtccccgttaaatctccgcttcttttggggggcggggaaacggggatggctccagaagtcaccctacagctattgcctaggctcaggagatgcccagtaaaacttcctggtgaaaagcaacaggtctttcagaactttagttctctctctcctacagcagaaggtacctgcttgtgaaacactaggtgatccagtgtcccccttggtttttaaatcctgaaggggtgttgttgattggggaaagtagcttcgcaatgttctgatctgaactttagatatttaaatatttatgattttcaaaattcaatcatacatttaaaaattttatctcaaccttagaccaacttatgtcttatttgacttagaaatataaagctttttcattttgttttttgattcaaattaattaagtcataacattaaccaattagatcctactgaaacaccttccacagccttcataattgaattatctgacaagtgtttcacaaactttacagtattgggattatctggagaatgattaaacatattgaggcctgctcctaaccccagacacactgatttaatgggtaattgttaggtagttagacattagcagttgggaggggatgacagaagagagcggaaaggctgtcactaagacagccactggcccacctaaattcaggcccaagactaccctaatgccaccctaagggatggagtttatgataaagtctgtggccaaaatatcctggagaaagagaaaggagggtacaggtggaaattccctaaggtggcacatgcccaacaacacaaaagcctgtcttcaagttcaccccaagttcatcatgccatcattataatagaatttacatacagttttgcccccccatccctgggaggcttttcttaacaaattataggtaagaccatgcacagtttaattttagattgtatagctatacacttcaatcaaataacatcatcctgtcactcagatacagcccaaacctcaactcctccccacaaaccccataaaagcaccttgagctctgtaaagaagtgctgagttcacttcgcagaaataagcccgctgtccctcagagtgtattattgtgcttcaataaactttgctttaagcttgcattttggtgttagtttgtagttctttgctcactatcacaagaactgagattgctggttcagagctccggctataataatctcctcggttaaaggatccatcccaatgcataattcccagtaacagtatgggatgccacctgggcaatgggattttaaaagctttccttctccctcaacgaagtttgggaattattgccttagacatttcaaacaatattaataaatttaatacacctgatttgctccaaacctttacatatctagcaaattcaacaggcattatttttgtaagcatgtatgcaaattttggcaattcaagaaaatcaaacaggatatcagggcctcgactgtaggcaaacagatacaataacattggaaacatgtagaatattgatgatgggcacattggggctgatagtactattcctttttttcaatttttggtaagatataattagcataccatataattcatctatgtaaaatgcaaaaattggcccggctcagtggctcacgcttgtaatcccagcactttgggcggccgaggaaggcagatcacctgagatcaggggttcgagaccagcctggccaacatggtgaaaccccgtctttactaaaaatacaaaaattagccgggcgtgatagcaggcaactgtaatcccagctacattagaggctgaggcaggagaatcgcttgaacccgggaggcgtaggttgcagtgagctaagatcgtgccatcacactccagcatgggagacaagagcaagacttcatctcaaaaaaaaaaaattagctgggtgtggtggcatgcacctgtaattccagctactcgggaagctgagacaggagaatcgcttgaacctgggaggcggaggttgtggtgagccgagatcatgccattgcactccagcctgggcaacaagagcgaaactccgtctcaaaaataaaataaataaaataaaatgcaaaaattaatggattttagtatatttacagagatgtgcaaccattaccaaaattttacatttctatctccccaaaaagaaaccatgttcccctaattcagtacccttaattcatcgcctcccagattcctccattctcctcctcctcccctcccagccctagacaatctttaatctactttctttctatttggaacatttagtatacatagaggcatataatatattgctttgccgtgactggcttctttcatttagcataatgtttttatgtatgtttttcatggaccaataatatctattataaggacataccacaacatattttatttattcattcatcagccgatggacattggtttgtttctactttatggctattgggaatagtgctgttataaacatttatgtacaagtttttttgtagacttatgttttgatttcttttggttatatatctagaagtgggtttgctgggtcatatggtaacactgtttaaccttttgaggaattgccacattcttttccaaagtaagcattttatcctcctatcagcagtgtatgagagttctgatttctctccatctttgcctgggtttttgaatcagggccccagatagaacaaaaatgtggttattcagttgttccaccatcacttgttgagaagactcttttttcattgaagtgttttggcacccttatcaaaaatcaatctaccataaatgtgagagtttatttctggagtctcaattttatcccattatgctataatctataatcctatctttttttttttttgacagagcctcactctattgcccaggttggagtgcagtggcccaatcccggccactggctcctcctcccaggttcaagcaattctcctgcctcagcctcccaagcagctgggattacaggtacctgccaccatgcctggttaatttttgtatttttagtagagacggggtttcaccatgttggtcaggctggtctggaactcctgacctcaggtgatctgcccacctcagcctcccaaagtgctgggattacaggcatgagccaccacacccagactataatcctatctttatgtcaggactacactgtcttgattactatagctttttagtaaattgaattcaagaagtttctcaacttcaaatttgatctttttttggaagactatattagctattctcagtctgctgaatttccctaggaattttaggatctattatcaatgtctattctatttttgtatatgttttaatattttcataagaaacttttttcatttaaacttttttttttaagaaaaatagtgaaaatcagaacactgggggtcaggcgcatttaacaggcagaagaagaataaaaacttgtcatataaacaaaaaagaaatgaccaatcacattgtggaagccatggagtggttataggtgccaaaggctgcagagaaatggtgtcagatatacctgaaaattgtccattgtatttggccattaagagacttagaagacttaagccatagattgctcagtgagaccccgagggcaaatggtctgaaggtgaatagatcatttcacctttaagagagcaggtaggaagctataaatccaagattaaaaagttgactgaactgttaaggaagaaactctaatcttgagccaccctatcctggctccaccttctgctgcaagcaaacagaaatgctgaaattcaacactcacaaaggctggtaagctggaaatgacaaaaattactcctgggaaagtcagatttagaattaggccatatttgttggggttcagattttcatgtacacttgggaaagggtttagcttataggcacatgcatgaagggaactggtatagggctgtgttcataaggtcaagagttgaaggccaggcatggaggctcttgcctgtaatcccagcactttgggaggccgaggcaggaggatggcttgagcccaggaattcaagaccagcctgggaaacatagggagatgctgtcttcacaaaacaattaaaaaataaaattagtcaggtgtggtggcacacacttgtggtcccagccactcaggaggttgggaagatcacttaagcctgggacattgaggctgtagtcagccatgatagtgctactgcacaccagtctaggtgacagaatgagaccctgtctccaaaaaaagagctgtatccacatcccaggaaagtggttgaagatctacttttctctgtaaacctaataaagaatagagtgacaaatgtgtgttgtggaaagaaatggggtgagagctacgtagatgcaaaacaatacatccccacataccacttgttaatcatccttttccacccacttatgggatgaattgcatctccccaaaagatactctgtcctaaccctcagtagctgtgaacctgaccttatctggaatacggtgagttcactggttaagaagagattatagtggaatagggtgagtcctccaaccaatgactggggtcctcacagacacagagggatgatggccaggtagagatggaggcagagattggagttatgctgccacaaaccaaacacaggaagctgctagaagtggaaacaggcaagaaagaatccttccccagaggctacagagggatcttggccctgataataccttgatctcaactggcctacgtaactgtgagagaataaatttcttttgttctaagccacccagttgatagtactttgttacggcagccctaaggaacttgatatacatttcttttactgtcatagaagttttgaatcttttaagtaggtctgtacccttcctcccagtgtcaacacatggaattcctctccttgtgccttgaaaagtgaaaggtgtttgaactggtaatgaaagaaatctcagcatgaggccagatgctgtacctcacacctgtaatctcagcacttcgggaggatgaggcgggcagatcacttgaggtcaggagttctagactactctggccaacatggtgaaaccccatctctactaaaaacaaaaaatgttatcctagccgggcatggtgcctgtagtcccagctactcaggaggctgaggcaggagaattgcttgaacccgggaggtggaggttgcagtgaactgagatcacgccactgcactctagccttggtgagagagcaagacttggtcttaaaaaagagaaaagaaaaatgaaatttcagcattatagaataaaaatgtttccccttccccccaaactttaaaaaagcagaagtctgcatcataaaatggtctttgccaatgttatttttattataacaaaggaatcttgcaaggctaccagatctcagcaattgtcactatgttctgtaaaaatcacttcctaaaatgtctgaattgactgcttgtctcatttatttgtttctcgtgtcatactgcaatggatatctgtcttgttagtataaatatttgtgcattttgttgttgttaaaacagcttttttggcctgtcttcttccacctatgaggtaatataaaactcatgtttaacacttatttttgtagcaggacaagctacagacaaaacccctcagacactgagttaaagaaggaagggctttattcagctgggagctttggcaagactcacatctccaaaaaccgagctccctgagtgagcaattcctgtcccttttaagggcttgcaactctaagggggtctgtgtgagagggtcatgatcgactgagcaagtgggggtatgtgactggcagctgcatgcaccagtaatcagaacagaacagggattttcacagtgtttttccacacaatgtctggaatctatagataacataaccggttaggtcgggggtcaatctttaaccagacccagggtgcaacaccaggctgtctgcctgtggatttcatttctgccttttagcttttactttttctttctttggaggcagaaattgggcataagacaatatgaggggtggtcgcctcacttattcaccccctttgagaatctcactcattagtgggagttctcacttttattctcactacctatgtcttcttgaaagacagattgataatgattcatatagtacacttgtgctgaagcattttggtgagctaaggtagtgatgaagctttttatcatttggagaagtacaggtagcaaacaaggaagcagtaagcaggtttctattaatattataactcctattataagagttttaaatcttcttagcactcggaaccatttttcaaacatggccccagaaacaaatccataccacacctacatgggcacatgtgccacttttgtcatatttctaactatgtcttcaactacttgcccttaatcatctatgtgtagacagcaattagtaaggttaaatttcctacagacccctccttcagttgctagcaagtagtcgagagccaatccattttgatagatagcattttgcatctgagtttcttgccaggccacagtagtcagggctctgctggtcttattagtaattatttctaagacagcttgtaaccgtatgattcagttgagcatgtaaatgggggtcccatatccccacaagccgtcttgtgcccaagtagcaggcccataatattgtatgattctctcagggggccattcattatttttccaattttctatagctatgctttttttttttttttttttttttttttttttttttttgcgggaagcatatacagggaagcccaggagtttgcctgtctttatgggcagtaggaagaaagatggtttagtagtgtcaataacacaactacctgcccactggtcaggtaatttggcataagctgtatgcccacatatccagtataatccagtgggggctgtccagtcccggtgggactctgggtgggtccacacagtttgcaactttgggaatttactaaatagatttttcttagtgtggtttgaactccactaggtggctgtttttatagtactattatacagtttttgcccaaggcagctgagtcttcccacaggaagggtgaagtccttccccacttttgctatacagtattgtctaatgattgaggcttttaggacccagaagttatcagggtgagtcttttgagctgggaatttatcaggaactgggtctgtaggtactaattctcgtgcttcccatggccattgatctcccattacagttcctccacatacatacataacatgaagtgacattgagagactgggctacatgctcagctaattgcaaaaacaaatttcttgtttttcctggaatttctagtactggcacattcagttcatcataagaaggtttgaaatactggctcaggggagcatttataaacttctcctcaaaccaccatatttactcaaggatccagtccagccccaactatttctaaggttacacgatccccttttttccagtgagaatcaagggggttggttattactagttctaaggggttacactgaccactggtacaggaagggccacttttccctttctgaaggtggacaggattctttttattttttaaccaagttgcctaaatgacacaagaccagtatctacatttatttccacgcagtcttaattcatgacaagcgtacttattttctgccatatagcctctttcctaatgaacagaaccacatcctatttctaacttattactattaatgacagcacaggcatcaaatttcaaggtgacttgtttgggcattcctttttcttctgttttggctaacactttactcgtatcgtttatgaacccccaccagtcctcagtcctcaatcttatttcaaaaactgtggtcgtgggaggctcagatgggtcataacacacatcaggttggtcatttcttgggctacctaccttgtatagaatagcattatacaaacaagttatttttagagtctttgtacacttataataaccataaaataataagactgtagcaactttttgtcctacctcagtgacttgatgtatacactgggaacagccctcagtctgaggaaggttagttgaagtctttactgtgcaagtccaaattttaaggaaaatgagtcccttgatgagttttctcatgtttcggccatgcatggaccagtcagcttccgggtgtgactggagcagggcttgttgtcttcttcagtcactttgcaggcgttggcgaagctgccacgtacagctcacagtctactgatgttcaaggatggtcttggaagttgggcccactagaattaactgagtccaatacctctactcagtcactttcaactgggctttctgataccaggagcaaggtggcaggttttagggtgttgcaaatttcaatggttatgcagggattttcacatagcaaactttggtacttggttaatctagcatttgttagccaatgatgtatttattaaagtcaccacagcatggagggcctttaagtttaggttttgtccaagagttagcttatctgcctcttgtgctagcagggctgttgctgccaaggctcttaagcatggaggccaacccttagaaactccatctagttgtttggaggcccagcctcggccagggccccacagtctgggtcaaaactccaaccgccattttttctctttctgacacatagagtgtaaagggttttgtcaggtcaggtagccccagggctggggccgacatgagtttttcttttaactcatgaaaaactcattgctgttggttgtaatagatgtagtttatccaatctacatttttattaactgtcacccaccaaaatattgactcaaatcctgcagctatttgattttgggatttaaattgatctgctattccctgtgggactccaattgcatctaaatagatgtgagagttgaaagacacataagggtcttctcttgctttacgatgtcttatttttcctccctctggttgatgaaatgctagggtgaaagggatagccaattggactaaagtacaagtgccgctccagttatttggcagagtgcccagtaaaggtccaccacaataccaccacacatccgcttggggatgaacaaaggctgactgattgagaagctcctgaaaattcttaagctcactgcatcccttcaggtctccaaggaatgctaagtttcctccctgtcatgagagacaagaagtgaacttagttttgggagatggaagctggatggccctcaggggttgacctgcagggtgctggactttgggatatagcagagagagcttggcacgacttattactccaggctgtagaatcctggaaaacagttaccatgcagcccatgcctggtcaacaggaggaccaccttagtggaaaggggataatctggccctctggcctgccatgtgcacaagcataacaattggttttgtttaatgtgtggacagaatatttgatccattccaactgggcatttgcatcttggtatcctgcttaattatcaaagtttgttttaagtctttaacttctatgaccctctagtaaaatgaatgtatgattttaggaaattacaaaaaccggttggggcagtccatccttgctctttagtggtccacacaacattcgaccaactatggcataaaagctctacatcggggggcaagactcctcgttgacactggggtctttattgaaatctctctggaataaatggtctcagtttactaaggctcagtctgaggagagtcaggagggacagaggtacttttctgaagtacagagatgtcttcgacttggcaagtccccacagggtataacaaggcaagcattaaattcaatagtttgaggcaaaattgacttggttatgttaataactagatggtcagaaatagagtgagggaagaagaaagagtaatagaatagatgaaggagttaaatttttcttagctttagtttggtagggttttcccctgggactatggcccatgactctggagggggtggcactttcttgactcgggtgtgatgagtccatccctttttcaccgtatgaacaacagtctcggtggttagcagcacaaggtagggtccttcctaggctggctcaagttttccttctttccaccctttgatgagaacatgatcttcaggctggtgctggtttacagaaaattctaggggtggtacatgtgctaaaagacttttagttttgagggaaaggaaagtggaagataaaccaagtatataacttttaagaagttgaccttttgttttaaatgtggggacatcagcagtggactttatagtccttggtgccttcttactgagaaatttcctttagcacctatttttattagtttttagaccaaagaaagtcaaatgccattttatatttgacaacgcttcttgtatgtttataccagataagctagatttcacctttatattggtgtgttattaatgttaaacttagttttaataaaactctgtagacatatttatttgatttttaatgtctgaccataaggtaagatttttatagacttttctttaaccttttataatttttgttaaagaacaggttagtgctttaagaaaaacccgttgtgtttttattttaatgttcagttcacagaaaaactgtatgataccccttaactttagccaatatgtttagacacagaattttctttacaattaaggtttcaaaacttgcttaaaccttcaaaacaatttttgtaaccttttaatgtaggtaaaaatccacattcttatgcatcctcataatccttttaccaaaggtatattttactttccttacataccttgcacataaactgtttattcaatagttttacatttagaaggaggcctaattacttttaaattatacaacatttcttacataaatttatttttctaacacacatttttttcatgactttcacagacaattcttcgacatgcctcaactttctgacttattgcaaacatccctttctttaaacaactagttaatttatctcaggacaaggattttccatacaacattcttttttatataaattctgcctcctctttatttccttttttttttttccgaggatgataaccattcttttccaaagcgaacttcttttatgtctgtggactagactgtctaaggccacaagattagaagttactataatacatgttacactgttaacttttagcaaactttacttttgttgaaaaccttgtaagtttgggatttcaattatcctttgctattaataagaccttatttagtccaaattaacttagaattggtatagatggcttttttttttttttaattacctgggaggaaccatctatcctcctgtcctgaagggagttcctcctaggtctggtcagagctttgtatggtaattaagatttagatcccctgttaggaaacctgccgggttaagagaattttcagtggttaatgttaaatcatcttcttttttcttttttccttaggatacttctgaaccggtgaggtgtgctcacaatgaggtttcctgtaaaagttatttttttactttcttctgttagcaaagcagttgccgctacagattgaatgcatttgggccatccgcgggttactgggttaaggatttttgataggaaggccttaatgcttttggaatatgccctgacaacaaagtgccagttccttcccggtgttcagccactgcgttgatcctccacgagggcctgccacgtgctgctctggtgaggcgttccaccggggcaattgcctacctgggagcgctctccagatctgtgtcgctcaaactggctggagttccccgtagggatgctccacagggcaggcctaagtcgcctaaggggctgccttgaccgtccgttaatcacctctgtctccaaaaaccagctccctgagtgagcaattcctgtcccttttaagggcttacaactctaagggggtctgcatgagagggtcgtgattgattgagcaagcagcgggtacgtgactggggctgcatgcatcagtaatcagaacagaacagaacagcacagggattttcacaatgcttttccatacaatgtctggaatctatagataacataacctgttaggtcaaaggtcgatctttaaccagacccagggtgcggtgccgggctgtttgcctgtggatttcatttctcccttttaatttttactttttctttctttggaggcagaaattgggcataagacaatatgaggggtggtctcctcccttaatttaaacaaaattttcaaagtcctaccccaagtaaattggcaaatattaataaagttatggcatagaaaataaaaatgattgtaaaaggcgtaaagatatttctgtggggaaaacatttgttcattagttatcagttaaaattctgtgaaaaataaccactagagaccctaaagtacccaggggctaataataagaagggaggaacaccctctcactccccaccgttacctgcccagaagggaagaggaagagggtgactccaggagagctgtggtctcccctccccatatgtccacatatacctgacctcccctccccaaaatatatacccaatatctctcccatatatacatatttatctgacctctccacatatgtatacctaaactttctctatatatccacatatacctaaccctctcacacacatatagctgacctccagtggaggaaaatggggaagagagaagaagttatcaaaggataaatctaggtcatactcagaaatgtgaaaaacaaaaaccacacacagaaaaaaaaaacacacacaaaaaagaaattgataaatttgtttgtgtcaaaattaagaattccggttcaatgaaggatcccatggataaagttaagacactgctgtaaggatggtagagaattaaatgtctgaatcagacgaaaggatgagtaattagaatgcacaaggccaagaagaacaaaacagaaactccacataaaaaatgtatgaggccgggcgcggtggctcatgccagtaatcccagcgctttgggaggccagggcgggccgatcaggagtttgagaccaggctggccaacattgtgaaaccccatctctacaaaaaatacaaaaaattagccgggcgtggtggtgggtgcctataatcccagctacttgggaggctgaggcaggagaatcacttaaactcaggaggcagaggttgcagtgagctgagatcacaccattgcactccagcctgggtgacagtgtgagactctgtctcaaaaaaaaaaaaaattatatatatatatatatatatatatatatatatatatatatatgaaataaatgaacaagaaatttagatacaggaaaatccaaagcacttggtaatgaaagaaaggtaaagtgatgtgtccttttgcatttaaaagagagcattaacaaattagagagctgaataatgctcagtattggtgtggatatggagactcaggaatcctcatacactgctgatgggagtgcccactccctgggaatattttccaaatatcatctcaaacatatcccataaaggtgacaggaaagtgtgggctgactgatatccttcactgagagaggtggaggtaaaatgaagtcactgcacaatatagagttggaagcaatggattagatgtccacatagttacgtggaagaatccgtaagatacacacacacacacacacacacacacacctttgtgtatattgttcctggcaggtaggcatggaggtttagaggctttctacatcacacctactgcacacagtaaatggccaggctgagcactgacttccatgaagggagattgaaggtaagagattgaagattgttccctggtctgggaccctgcaactgaatatgcagaaaaaagtacaccccgccaccccgcttcccatctttcctacctgattagaatagctttttcagaaaacgttggccaggggttgtggctcacacctgtaatcccagcactttgggaggctgaggcgggcagatcatctgaggtcagaagttccagaccagcctggccaacatggcgaaaccccatctctactaaaaatataaaaaattagcagggcatggtggcacacacctgtcatcccagctactcgggagcctgaggcaggagactcacttgaagcacagtgatggaggttgaagttagctgagatcttgccactgcactccagcctgggcaacagagtgacactttgtctcaacaacaacaacaaaacccaccaaaactttaaatctacctatggccaaatgcctgctaaaatgagcacccaagaagcagtgttcaggaaagtcagatgaataccctaaaattagatgcaatgttggctggtcacagtggctcaggccctgtaatcccaatccttcttgggaggccgaggcgacagatcgcttaagctcaggagatcgagaccagtctggacaacatggtgagaccgtgtctctacaaaaacgtacaaaaatgagctgggagtggtggcgcgcacctgtagtcccagctactcaggaagctgaggtgggaggatctcttgaacccagaaggcggagactgcagtgagcagagatcatgccactacaccccagcctggatgatagagccagacccccatctccagaaaaaaaaaataaagagagagagagatgcaatatttagggttcaacaagactgaatttctgactcctttccctacctctccagcatgttagattctgggtccttcatcctaaccccctgttcatgccatagccaccctgtggtaccaactttggaagcctggatcttcatcccctcatgataatgagtgtcccatcaggtctccatgctcagcttggcaagagtatctgtcttctcctcatgggacggtcacattcacccagcactgacaggttccattcccactagggtggcaccctatatggtctgagtccaggccttcctggtccctcagtaatctcagcatggtagcacaatcgaaaagggctaggcacggcagcaccatttcccaccaagaggtctgatggctcatcacatagactgaaggagattctgaagagcagaggtggaatgaagaatgaatcgtgggctctgctcttcctaggcctgtcttcctctctcccgagatgttagctaactcatgagagccagaaaccaactgcaggctggcctcaggcacttaggtagtgcttcagcctcagcagtccacattctaggaaccctcataatatgggttgaagtatgcattcccacaaaaataaagttgttgaagtcctaaccaccagtactgaaatgggaaaagttcccttgtcccgctcgcatggcatgtgataggagtgtggctaatttcttcagtgcctggctgctcaaacctctaggggaacattaagacgggcaggttgtgggtctccaaccccatgaccccaccacagtgtctagggttgaatgtttacagctcctgaagccacagtgggtgtgtgttacagggtgctcttttagttttgccatttataggcagctggtgttaaccaactcaattagaccgtctaccttgtcccaaggacagaagaaggctttctgtatcccaggttcttgccttggtgtaccggaataaatcagaccacacctgggcttagagaaagagtgcaaggttttattaagtggaggtagctctcagcagttgggcaaagccaaaagtggatggagtgggaaagttttcccttggagtcagccactcagtggcccaggctctcctccaaccaccccagtcaaattccgcctcattttgccaggcaaacgtttgttgtgtgctcttctgccagtgtgctcccctggacgtccagctattcgtgtcttgtggcaggccaggggaggtcttgggaaatgcaacatttgggcaggaaaacaaaaatgcctgtcctcaccgtggtccctgggcacaggcctgggggtggagccctagccggggaccacgcccttcccttccccacttccatatcatttaaagggaccatgcccttcccttcccagcactttccccctcctgtatcaggacctgtgaatgtggccttatttggaaatagggtctttgcacttcatcagttaagataagagtgggctctaacccaacataaagggtgtccttataaaaaggagaaatgtcatacacagagactgacacctatagagagaaaatgtggtgagtagacacagggagaatcaccattcaagtcaagcaatgagtctggggataccagaagctgggagagaaacctggaacagattatccctcattgccttcagaaggaatcaaacctgatgatactttgatttcagacttccagcttccaggactgtgtgacgataaatatctgttgttaagccaacgagtttgaggtactttgttactgcagccccagaaaactaatacagtaggtactatggactgaattgactccccgtcgcaaaattcatatgttgaaaccctaacccccagtgtgatggtacttggagctggggcgtttgggaagtcattatatttagacaaactcatcaggatgtgtctctcatgatgaaattcatgcccttattaaaagagacaacaggccaggtgcagtggctcatgcctgtaatcccagcactttgggaggctgaggtggatggatcacctgaggttgggagtttgagaccagcctggccaacatggtaaaaccccatgtctactaaaaatacaaaaattggccaggtgtggtggtgcacgcttgtactcccagctacctgggaggctgaggcaggagaatcccttgaaaccaggaggtggaagttgcagtgagatcacaccactgtactctagcctgggtgatagagactccatctcaaaaaaaaaaaaaaaaaagacaatagagccaggtgctgcagctgatgcctgtaattccaacactatgagaggctgaagcaggaggctcgctttagcccaggagttcaagaccagcttggacaaaatagtgagacccccaacttctaaaaatttaaaaaatgaactgggtgtggtggtacacatctgaggctccagctactctggaggctgaggtgggaggattgcttgagcccaggaggaggctgcagtgagccattgctgtccagcctgggctacacgagaacctgtctcgggaaaaggagaaaacagtgagacctctttttctctcctccttctctccactgcctaagccctacaagcacaaaaaggacaccacatgagcacatagtgagaatgctgctgccaccaacaagtcaggaagagagcgttcacctagaaactgaattggccagcacctggatcttggacttctgagcttccagaactgtgagaaagttattttttttttagcgactaagtctatagtattttattacagcagctcaaggtaactaacatagtagaagggatgaattatggagatcacaagtccacgcctccagaaaaagacttccctaaaaattagtctgagcaaaattcgaatgatgaattatttttaagaacttttaagggatctgacaagtttgcaagagctagagaatgctttacaacgtgataatagaatgctctgtgatgacagaaatctttccacactgttcaaaactagctactggccacttgtgactattgtgcacttgaaatgtgactggtgtctgaggagcagaatgtttaattttacttaattttaattcattacaatagctacatgtagctaggggctactggattgaacagcacagctcgagtcttttagagggagacaggactcaccaagatggatgctggtggccaagcagcaatggcaggtagtacacacacaagaggcagatgatacaacacatccttcccaaacctggagataagctcaccccacaatcccgccgctgaaatagagttgatgttaccaatgtgcatttttatgtccttttccatacagaaagatcattcagcaagtactatggtacttaaaaaacaacattcaattcattattatgacaaaattaaattaatagctcttccttaaacttttaaattcaatttacaatgcttactattggcatttattaatctaccaattttttcccatagaacccatagaacaaataatctaccaaatttttaacattcatttttggcaaggcttttgcaatttgacgaactttaagaagaaaacttataaattgcaatttttaaatctgacatactggacttttaaagtatccaattgactaatgaacaaaactgctccaaatttttcaattcttaaaaatcttaagacaatacttaatatggcaaatcttaacttcttaaactttgtaagaatgctaatcaacttagattggtataaagttgagttaaaaatcacaggatacatcatctcagctataagttttcatgagttgagtttttacaatcacttgaaatgcttagaataggaaatacgtataaattatttaacataaaatattgttacaaaacctctggagtgtcagtttctctggccagactttatgctgcagcacctttgcctgagttcttgtcctgcatccaggaagaattaggtacagaggcaagagtcaagaagattagttttccaatagttcagctcacctagttaactcctgttcacaatcttcaaagttatcagaaacctgcaattgagggttataatccattctttgcagagtttcaaaacaagacaacatttgtctatgaatgttaaaatgtcctagggtagtcacagtcaaaaacacaattgacaaagaaatttagtcacctctgtgatttacaatagcctaacacaataactctaattataactgatgacacaaactcagatatcagaactctagaaatcccctataattttggaacacacattcacagttttcactgaaatatgacctgaagatcaaatatcaccttatttcaacaatcctatataactaaacgtgtcaaatgatcctgtttacctctcctttggatactccaggggccctctgtagcatccaaaagttaggggttagcaaagacaattttgaagctgtaaaggctcaaaacacttaatgaacctctagtcatatctgttctctactcactaaatgctagtagcacctctcagttgtggctaagctgggaggatctcttgagcctagaagtttggggacgcagtgagctatgattatgccactgcactccagcctgggcaacaatgcaaaatcctgtctcaaaaacaaaaacaaaaaacaaattgcctatgctgtggttatctcacaattaataaaaaggaaaaaaaaagtatgcagtctttgtaggtccttggggtttgttggaactcagaaaacaataccccaaaataaagaccgcagaagccaaagtttttctctgatcttctcctgccctcctgtctctgagtcccattctccccggagtctagccatagaaatgagaattcctcttcctcaagttaggtcatagaaatcaaaacaccttttccccagagcccagccataaaacctaaaaatattactctaactttccctctgtttttctgtgtaaaaactggccataaagaaattatctgaactaccttatttgatcatagatcaccagaccgcattccagagaggatccagaaggaaggaatgctgcacagagaggcgaagaagaatctagacagacaggccttgctgggtttccctactctgtttattagcaatcctatttctacacggcggcccatactttgttgaatctaaaaaataaaaatggacaatttcccctgtacatgttaatacacattaataaattggatataaattggataatttattaatatacacattaataaattggatgcagccgggtgcaatggctcacgcctgtaatcccagcactttgggagctgaggcgggcagaccacgaggtcaagaccaccctagccgaaatggtgaaaccccgtctctattaaaaatacaaaagttagctgggcgtggtggcacatgcctgtagtcccagctactggggaggctgaggcaggagaattgcttgaactcgggaggcggaggttgcagtgagccgagattgcgccactgcactccagcctggtgacagagtgagactccgtctaaaaataataataataataataataataataataataataataaattggatgcattttatcctattaatcttcctcttgtcggtggttttcagcgactcttcagaggccaaagagtaagttttcccttagcccctacaggttcttatgtttaatttgttactctcatttaagacataattaaagtggcttctccatgaagattatttctgcatccattatttggtaagattggccgttttctcctttgatctctacttcacactgacccacataaaacatcactgcctgtttttttgttgttgttgtttggagacggagtcttgctctgttgcccaggctggagtgcagtggtgtgatctccgctcactgcaagctccgcctcccggattcacgccattctcctgcctcagcctcctgagcagctgggactacaggcacccaccaccaagcccggctaatttttgtatttttagtagatacggggtttcactttgttaaccaggatggtctcgatctcctgacctcgtgatcggcccgcctcagcctcccaaagtgctgggattacaggagtgagccactgcgcccggccccgtttttttttttggtttttgcatgtcttctcccttttactgtaaactatttccactaccagcgtagttatcatttctactgcttaataattgttttggggaagtgaatgcatcaacccacatgaatttcttgtctatttgacaatttattctctttaggaatagtattaactcctaaggtcctgggagccagtctctgtacttggctgctccagggtcctacttcagtttcccagcttctcagtactgtcactgtcaattgtgggtaataattatttttgtccaccaaaagactctgtatgtgaatgagttttgaaatctgctgagtaatacagtgtcaacccagttaatgatttgccgggcggcttgatcaggggctgtccaactaccggcattttgatttggagcgtcatctagtgtctgaaagcacaaacaacatcctacattgtaaatgcctttggctacagagattgaaaccaaagcaaacctatgttttgaattgttattcttcagcagttctgctagctttgaaaaatctaaaagttaaaaaaaagctttatatttcattttctgcctaaactctttaaaattgctagttgacaattagatattttcaatttaatgaaatttttttttagttcacagattaatacacaatgggggagggttcttattctgttggacttttacataacctccactttagtgcagtctgctttatggggtcttgtttgaggtgtgtgtgtgtttaagggaatgtggtttacaatcaaaatattgggttgctcttaggcacattgtaaagtcacacacctgtattcttattgatacataatgattaataacattattattacagcctgatcaccatcattattgatatatctaaataatgaattttataattttgcttcctgtcaggcaagagccaatttcagtgctaccatgtttgtatagcagtatttatgtctgtcatcctcagtcattttacttcacttgttcttagccaaacggccgagaagcgatggtcattttacttcaaaaatgaaaagaattaatatttttacgtttcccttaaagaccctatgtttaacctccactcctgggtaaaatggtctagtccctccttttcatatcatctctgatatcttttgcacagccactattacctaccgttttctagatccctattcttcaaacaccaccatgaaggtagagcctgtctgaattattttcttgtcccctgaactcagtacattgttaggcttcttgaagatgttgatcagttgtttgtggagtgaatgaatcagctagcatgatttttctagaccactgagacaagtgtctaagacacttgttccttcccatgttcttgcctgcctgtgcaatccatgcagtctcatggcttcccagtgcctcagaattatcccctgtcaaacaggcattataatttctgtccactgaaaaggacaaaaaactaagtgtatagctagaagttaaaaattaccggccaggtactgtggctcactcctgttattccaacattttgggaggctgaggcgggcagatcacctgaggtcaggaattcgataccaggctggctaacatggcgaccccgtctctatcaaaaatgtaaaagttagccaggtgtggtggctcgcacctgtggccccagctactcaggaggctgaggcaggaggatcgtttgagccctggaggttgaggctgcagaaaaataggaatatactctctttcaagagttcgtggttttgactgccacctagcgtacatcagaaaaaccgcatgacataggaaatgcctgtgacagaggggtaaggtgagagaggttgatgaagaatgtattgaaggagtgaaaacgcttccatccctctacttactaaatatattagttaagtagttggggcatattttaattcatgcattttgtagatagaaaaacaaaagttttattctgtttgatttagttgatactttaatatgtgtgtgtttaggatgcatgatttataatcagtctgcagcacttcttggagaagtctgaattctcattctccatttccttattggcaacgtgagaatgattacaatggtggttgtctcatagaatgcagggagtcagaatgaaaatagtccatataatgcctggtgcagaggaagggttcagttaactgtctgtattaatattactgataacagtcatgacaaacaaaagcttaacaacaacaccaccaacaacagttgcagaattgagccaccaatttgcacacaagattgtaggtaggatgttttagaaaagttattatttaatatatgtatatatttttgtacttaaaatatgtcagaggttgttctaagaactatttaaatgttaactccttaatcctcataatgacccatgaaacaggtaggcttattattgtctctttacatgtgagaacactgagacacgaaaaggtttattaactcacccaaagtcacacagctggtaaaacggcaaaattgaatttgaactcagacattccaggttccaagacagtctaattattcttttgactaatatactaagctgcctctgtatttttccttgattactttgtaaaagtatgaggaaaatataagtgcttcaagtaaccatgaaaaatataaacaatctatgtatcaactgaagcataattacaaatcctttgataagcaaacataataaaaatttgatatcaatcaaaactttcatgtaatgtaagcaggttgagatgaattctatagtaaaaaagtgcagagtgctggaataccatgctcctaatatattggctaggcacacctgcctgctatcaaaggtatgcacacaccttggatacagaaagttgggactgggtagttatgtgagtgtcatcagaattctttcccacttgggaaagaattgtccatcataagcttggatgatggacaaggagtgagctcccagaacagtgatgtggggatacatcctcacatcacagtgagaatgagtgttctagactgtttacacacctaccactcctaaatgcacacatataattgcttgcacacacacacatacacactcatctcttctctggtggtccagctctatctcttatcattaggcttcttggggctagtacctagggcctgtatcctttcagaggcagctaagggaagcacacataattagaaagaatgaaccagcttgttggatttggtctcttcgcatccagccctccaagttaaggagagtaccatctttcttagggtcaccaaaggaaaaaaaaaaaaaagaaagaaacagaaggatatcatacagcaaggatctaatgcaaatatgcctcaaatgagaggctactgtgtgctgatcccaatcccaggaactgtatgcacattatctaatttaatcctcactgtatttctgggagtattattcccattttacagagaaggaacttggcagggtaaccaagctcatgaatggagaaactgggattaaatataaagcttccttgctccagaactgctgtctttctgctcttccacactaccagctcagctgtgctctctacatgcaggcagttttacaagtttcagattagcctgggacttccagggttttgaatgggttagggaatggggaacttttgggtttactttccattttttcttcatacatatgtaatatataacataaatctatggtatatatgataaatatatggctacatatgaactatataatcacatatatgcattataaataaatattaattttataatattttaaaggttatcaaataaatattaatataaataattaaataattaatactcagctttgttttccaaagtgataaatgcctatatttagcaaaatattttttggaggcctgatagtttttaggagtgtaaagaagtcctgatatctaaatgtttaagaaccactattttaggctgttgtcttctgtcttattttcccagctagactggtaaatacttgaaggcaaacgtttagccagcacattaacattttatgtttttattcttttgtgctctcagtggctgtgtcttttctatcgatttctcacactgtatgatggttatatttgtctgtatctgtcccaccaggtataagttcttgagaggacacactgctaggctgatcttagtttttattatttctcctggtgtcctgtgcttaacaagtgctcattaagtgtgtaaaaacacagcacagtaaaaaactagacattaaaaaataatgtcaaccaatctattgaaatttgcatttccatgtttcttccaatatagtcattgtgtcaggttatgtacttattctgatgaagactattgcctaatatacgtttgcatcttgtgctttataactgccttcatatagacacagattgagaaggtgtaaaaatgtgcatatcctcacaattgacaaattcttatcctttgagggtaggtttgactttctgaaatgctttgacatcatttgaaagaagcttgaagaataagatagctgttaatgacccagtttcctatgtcacttatacaattataatggcaatttcaaaatgttaggtaaatatattttgcaatatattgttccttttgtaatactctctatgtatttatttatatttttaaattttatatttatgtatttatttttctggacagagtcttgctctgttgcccaggttagagtgaagtgttgtgatcatagctctctgcaacttcaaactgcttggcaaaagtgatcctcctgcctcagcctcatgagtagagtagcgggaactacaggcgcatgccactgcacccagctaatcactatttattatgctcctactgtgtgctttagtatattttctgttgttttctgcaacccattttgagggcgtgttagggaatacagatgcagtaactttcgtctcagcccttgaggtgaggaaatatttagcctcaggtttaatctaattgttggccatttgccttcaaagattgaaatatgagcaaaactgtggctctgggttatatgttaaaaaaaagtttatggggctgaagccaggcaacagacaagagcccctacaatcttatttaggctgaaaatatcctggagtccctgtattgttggtctcaagcagatagcaacactaacacttactctttgaggcaggcactgccagtggggtggctgttattattagcttcattaattggtgagtcaggaaaaaacagctttaaatcattcaaagttctggcctatacaggatttagtaatattaggttagctacatccaaaagatgacagaaccctactctaaggctgggcttggtggttcacacctataatctcaaaactttgggaggctgaggcaggaggatcacttggtgccaagagtttgagaccagcctgagcaacatagtgagacccctgtctctatcaaaaacaaagaactctaattggcatagtagaaggaaaaagtgaaagaaaaaccagctgtcaccctcattccttacacctgtcctaacaactcctctcactatcctttgaatatatcttggctgtttgagtctctctctagccccattactgctgtttggacttgacattttgctctgcatttttaacttttctaccagggtttccagaccctgaagagtgtggcatgaaacaaaactagtcaacctataatatttatgatgtgtgtgtaaataaaagaatacacaatatattgcattacaatattttaactgtgtcctcaatttgtttgtggctttcttgaggacatcagttttgggtgggacgaccacatccttaatctgaactttcccttggaggtcattcttttttttttgaaatagagtctcgctctgtcacccaggctggagtgcagtggcgcaatctcagctcactgcaacgtccgcctcctgggttcaagtgattctcctgcctcagccttccaagtagctgggattacagatgcacgccaccatgccgagctaatttttgtatttttagaagagacggaatttcaccatgttggtcaggctggtcttaaactcctgacctcatgatctgcccacctcagcctcctaaagtgctgggattacaggcgtgagccaccccgcccggccagaggtcattctaatagactttttttttgttgttgctcacaggcttgttcaatcttatttcaaaatttgagaaatacagtttccatggaacaccaaccagatatcaggttgctatggagttgatagtcaaaagctttgtatcttccagtttttcagaatggcttctaaaggttctgattcagagctcttaggcgaaattgaacaaccaagtgtcaaagtacaacattcaggaagttaaaaacatgactgacatatatgtactatatatagtgagcttgtgtatgtgtcaatgaatgatttaattcattaatgaaggaggaagcagaatcacaattaggtcaaaggaagatacgggagaataaaatatgtatttggtcagggaaaggatgtatactggaagaggaagggaaaatcagatataaagttgtttaatgacttattaggcaatacaataataacttttagggtcattttttctatattaagaattcatttccatctctatgacaaaatccttattaatttattaaacttctacaagtgaatgtttacttttagatagtctggacccaataaaatgtaaacattaagtcagagttactttcacgtaggacagtgttgtccaataaggtaccactagctacacgtgatcattgaccatttggactatagctagactgatttaaaatgttctaaaagtgtaaaatacacaccaggttctgaagatttatcatttaaaaaagaatgtcaactgtctttttttttagcttatttattatatgttgaagtgataatagtttagatatattaagttaaataaaatatcttaaaattaattttacttgtttcttttcattctttcaatgtgaccactagaaatctggaaagtatttatgtgattcacattctattttactgtctagtattgccttacatcatcaggtaccccataagtaggctttttagataattctctaatatagcttggaaggatatggagaaatatttttgcgttgcttttaagttttgcataactttttcaacacactttataaaggatctagaaaagggttggttacatgtttctctgtcttctggcctccaccatgttgccaggaggttggggacaagattctgggtggctggatgtcctaatggcttgaggtctggacttgagatttgcatataaagagatgtgattagattgagtcgactagaaaaatcatattagagaactgaatcacagcgattaaatttacatgtcgatttataaaccaggacaccaatttatagtgaaagaaggtccagttacctggtaatcaagacgtttcatagctattttcatgatggatatacttagctgagttttaaatgagaagggggttcattgcacatagaataagatctaagtgaaatgtttattttatttttttttttttgacatggagtcttgctctgttgcccaggctggagtgcaatgaggcaatctcggcttctggagtgcaatgaggcaatctcggcttctggagtgcaacgaggcaatctcggctcactgcaacctccacctcccgggttcaaatgattctcctgcctcagtttcctgagtagctgggattagagttgcctgccaccacgccaggctaatttttgtattttttttagtagagatggggtttcaccatgctggccaggctggtctcgaactcctgacctcaggcgatctgcccgcctcagcctcccaaagtgctaggattacaggcgtgagccaccaagcctggcctaagtgacatgttcttatattgttcctttctttctttttttttcgactgagtctcaccctgttgcacaggctggagtgcagtggcgtcatttcggctcattgcaacctctgcttcccgggttcaagcgattcccttgcctcagcctcctgagtgccaccacccccagctaatttttgtacttttagtagagatggtgtttcaccatgtcggctaggctgatctcaaactcctggcctcaggtgatccgcccccgagtctcccaaagtgctaggattacaggcgtgggccacggggcccagccttatattatttcttttactacaatatattagtatgatgcaggtgcttcaattgtttatacactttccataattttgtataattcttataccctgtcactctgaggaatagccggtctaagtgtttttccaccactgctaattcatccatcactaatctcattagactgttaattcccagaggacataagcacacaagcagacaatgtttacaaatgttggacaaatgttatttaataaaacaatggggtcacccttagtctaaaagatgtttcacttttcatttgtcattgaactcttatttgtaggttcccttttgactttcccacaatctaaggctgttctctttaacacatattttcatgaaaacatatatttgagcagaaattgttggggagttgtaatattacctttgtccctaaatatgaatctataattatatcaaatatatgggcagacaatttactttgcctttaatctcaagaaaaaaatagcaattacttggggtcggagagtaaaataagaagtagtgaaccttaaagtagcaaactttagaacagaatagtttcagaggggatgagaagaggtgatttttcagctcatcaacaacagatcttataataaattacatgttctggtacttttcttgtctttctgtgttaaattttgctatttaaaaaaataaatttcaaatacattgttcatcttaaaagtcaagagtgtgttttattaaagtcagttgctttatttgcaactcaaaagatatatttgagttcccaactggagattgtcctatatggtaacttgcgtaaggtatggttactgaaagtaacctacaattttcatgggctgaaattcatttctatattgcagcgtacaaaaataaataaataaaaaatgcttgttttctttgaaaacatattatctcagtgcctctaactgccaaatctattggcttttttgcaggcttaagggctctcccttgttcctttatgatctctatcttgagggccagacctcctgccttacacaactcagagggggacctcagagctctttaaaaagagcccaatttctcgcctgtagagaagtgaaaaggatgccccacccccatctatgaaaagagggatttgatagtttcaatgtcttcaaatcaaagatttaagtctgtagccccccaccaccccggaccctagcaaggctcatgaaccccctcccatcccgccctaattgctttggactggccgtggaatccttgtcccagtccacagttcctgtgcgactgcacgaagaattcacagaggacctgtgttacttcccttgtgaagaaacagaattatcatgaaaatttaggtggaaaccatttcgcttttttcttcaaaaataagggaagcatgtgcccaaccacccctgggaaaaagaaccttcaggggcaaaggagcgaacaggtaatttataagaaaaacagaaagtggtctctgactgccccagacttccttcggagttgggggaattggggacgcctggacgcgttgtttttgtgtttgtggaaaaaataaatgaagagcatgaagcccgaggcttctgagatcctttcctgaccaaacccaagtgatttggtgcggggaattttaatatttttccccttttgtgaggtggaacaaacacaacttgggagcagcgcagcggctcagagcctgccagccaggcgggcgaccagagcaccaatcagagcgcgcctgcgctctatatatacagcggccctgcccaggcgctgcttcatcggcgctttgccacttgtacccgagtttttgattctcaacatgtccgagactgctcctgccgctcccgctgccgcgcctcctgcggagaaggcccctgtaaagaagaaggcggccaaaaaggctgggggtacgcctcgtaaggcgtctggtcccccggtgtcagagctcatcaccaaggctgtggccgcctctaaagagcgtagcggagtttctctggctgctctgaaaaaagcgttggctgccgccggctatgatgtggagaaaaacaacagccgtatcaaacttggtctcaagagcctggtgagcaagggcactctggtgcaaacgaaaggcaccggtgcttctggctcctttaaactcaacaagaaggcagcctccggggaagccaagcccaaggttaaaaaggcgggcggaaccaaacctaagaagccagttggggcagccaagaagcccaagaaggcggctggcggcgcaactccgaagaagagcgctaagaaaacaccgaagaaagcgaagaagccggccgcggccactgtaaccaagaaagtggctaagagcccaaagaaggccaaggttgcgaagcccaagaaagctgccaaaagtgctgctaaggctgtgaagcccaaggccgctaagcccaaggttgtcaagcctaagaaggcggcgcccaagaagaaataggcgaacgcctacttctaaaacccaaaaggctcttttcagagccaccactgatctcaataaaagagctggataatttctttactatctgccttttcttgttctgccctgttacttaaggttagtcgtatgggagttactgaggtatcagacgaattgggtgacggggttggagagtggccgtggtgaggttacagcatttaaacctttattgcggcttctaggtccctgaccggaggcttttctcgctggcggatggttttgggatggcagtcccgccccaggcctgtgaacggcagaaaagaccgcaaaacaagagccagtttcttagtctaaagggatgtccggattggactaaaaaattttcaaaagtcccgccctgctcccgggttggtccgttcttctagtacatgactttcattctgtatttaattggatggtggaagacgttgcttattctgtgttttttgctttactgtgacttaaaagttttgcctcttttctctttatattaatgtctgggatttcggacgctttccatgttgttggtagtcaagttgatgtctcctggaggtagtggcaacatccagccctgggaggagagtgcgtgcaggtacctttgtcctacattcctctgctgttaatttctcattcctgtggcaacgaaggaatgcatttaaaaaacagccacaacagcggcaatagcccttcctccacccaaggcaatcgtggacctagggagttttttgtgccacataacatgtagccttccgctaaactgacaggtttgagcgtatcgattttgagcgtatcgaaagcacaacttttagccagccattttgtcctcgcatgactacggttgcttatcctgtttagacagacagcaacatttaaaaatcgaagttcctttaaacgtattttgtttggcagtccaaatgtttctatgcagaaaacagtatttgtactattaactatgaagagtgtatggataaatgggagacatttctaataaaggccttcgttaatggttccctctgtttgacatccatggtgcttctgaatacagaaagcctagcgtcttatattcgcttcttttaaaatctggtgggcacattttggtgagacctaaattatggggactggggcttctggagataagctgctcaattattctaccatctccacaatgattaatatagtgagttgatttgttagtgatagtgaccacggattcatcccaagaaagagaaaggggagggaggcaagcagagagacaggaagacagaggcagggaagaaggagaaaacattctcccatggtttaagtaattttgtgttgttaattttacattacaacacggtttaacatggtgaaccctctattttggtgtaaggtttaacatatggacatatttttcccaagaccatttatgaactttcatttctgcttcccccttcttcctcccgtgccaccctccacgctcctatcaattttggctgttttgtcataggctaatacgctataatttcatggacagttggactgtcttaggtttctcaggtttctattttgttcctttagtcattcccacaattcttaaggtagaattgtattgttttaaacattgtgttgtgtgctatcctcaatgctgagatgattatgtgacaaatggcaagtgttcaactaatacctaaatctgtagtatcttatcaagcctaatgctacttcacaatgcctactccattcacctcactttatctcattactggcattctgtcatctcacatcatcacaagtaaaacggtaagctattttgagagagatcacagtcatataatttatatttatatttatttatttatttatgagacggagtttccctctgtcacccaggctggagtgctgtggcacgttctcggctcactgcaacctccgcctcacgggttcaagcgattctcctgcctccgcctcccgagtagctgagattacaggggcctgccaccatgcccggctaatttttgtatttttagtagagacggggtttcactaagttggccaggctggtctcgaactcctgacctcaggttatccgcccacctcatcctgccaaagtgcttagattacaggcgtgaaccaccgttcacagactcaaatcatttttattacagtatattgttataattgttgttttattatcagttattgctaatctcttacagtgcctgatttataaattaaattcatcattgccatgtgtatatagaaaaaaacagtgtatatacggttcagtactatctgtggtttcaggcatccactgggggtgcagtttattaaacatgcatttacattagtctcccctttgggagactaattaactgagatgttgtaacgtgactttaatagcagatagagctaattttctctcattactcttctttttcagaattttcctggttattccattttttatttttccatatgtatattaagatctcttccacctcctcctgtttctccatctcaacatcaaacaattaaaaaaaaaaaaaaggctgggcgcggtggctcacgcctataatcccagctctttgggaggcctaggcgggtggatcacgaggtcaggagttcaagaccagcctcgccaagatggtgaaatcccgtctctactaaaagtataaaaattagccaaccatggtggcaggcgcctgtaatcccggctactcgggaggctgaggcagagaattgcttgaacctgggaggcggaggttgcagtgaggcgagaccttgcactccagcctgggtgacacagcgagactccgtcataaaaaaaaaaagccggaagcagtggctcacgcctgtaattccagcactttgggaggctgagtcaggcagattacctgaggtcaggagttcaggaccagcctggccatgaaaatacagcctggccatgaaaacacacaataaattagctgggcgtggtgtcacacacctgtaatcctagctactcgggaggctgagacaggagaatcacttgaacccaggaggcagaggttgcagtgagttaagatgacgccactgcactccatctgggcgacagagccagactctctctcaaaaaactaaataaataaaaataaagttatggtacattgaacttctgtgttcctttctcccttagatactttcatggctacccatttaattgatgttcttatcatctccaagagttagtcaggagaggaatcaacccaagcaaaaatagctgattttctaattttccttcaatgccctttggggtcttaatccatttgatttatgtactttcaattaatcctaacctcgaatgtcttctgcaaacatgtttccacagatgaaactcgtcaaatgaaacacattcctttaatttatagagttaaaaattagaaaaattttcaattctatttggcctttagattcagtcttgcatatgttttctcaattttgttcatgctctttagttttgttttattccatcacaattgttcacatagcttactggcttaggtctaatgaaccattcatttggaaattaaaattggccattttaagatgaaaaagattcttgcctcaattttacttagtttttgaaactgtcaatgaggacacatgtttttctgtactcttagattcactaagtagtgtcttgcaaatttaactgacaaaggacagattaacatgcgaaaaaaagagcatgcaattttattagtatattacatgcacagagttcccaaagaaaaaaaaattgaaaccttaaaaacgcggttagactcacagacttatacaccattccaacaaaggaaagggagtttgcacttcatgggatgacgaatttgggaatgtgacaaggaaataaatacatgggcaataaaaaccatggaagataaaatgaaagatagaaataattgtagtaaggtttgtttttgcagagtcatctcagtgccaaccttccatatctagtgataagaattgctctctttttcctggtatagcagttggggacacttttacaagggaaatttctgtcaccttcacaaagggaaatttgggtaaagagaagacagagacctcttcctacacctgttgattttcaattgccttcagctgaaaataacttttatgccaaagtagaataatttgggggtgacatcctgatattcttcaaaacttatatttaatttcacattagtaattatatcatttttgatttttaaattagttttataaaataattttgaaaaacggtaataatattcaaataattccagaaacactgctgataagccaaaaacatcaatgaatattgcataaacaactgataattcaaccatgaaaatttatgacattgttcttgtgtgataaaactatgagtaacataaaaactagaggctacttgtaatgcattattccaaactttctgttttttatttatttatttatttattttgagacatagtctctctctgtcacccaggttggagtgcaatggcgtgatcttggttcactgcagcctccacttccccggttcaagcaattctcctgcctcagcctcctgagtaactgggattacaggcacctgacaccaaacccggctaatttttttgtatttttagtagagacggggtttcgccatgtttgccaggctagtctcgaactcctgacctcagtgatccacctacctcggcctcccaaagtgctaggattacaggcgtgagccaccatgcccggcgcattattccaaactttcatacacagtgctatcatggctacaaattgaagtatcatattatacactcctaggcaaagctctggatattttggctatataagcctgagggaaatgtagtaaggacattgtggttgaaattcataccagagatgaacaggcccagtgcaagacagaattacatcactaaaggatatcagaagagaatagggatttagggtacagtggcaacaacagttttgggaactagcattttttgagcacttatttacaatatgccaagcactgttgctgattactctatatttattttcaaacacattcttgtcacagcactttgaagtaagtgccattgtcattcccacttcagggtgaaggactaaagcttggtgtcattaaggatgtagctagttagctgtgtgtgtgtgtgtgtgtgtgtgtgcatttttttttaaatttaaagtcaataaatttttatttgaagaatttcacatcaaggtaaactttgttcctctaaagagctggagtcaaaatgtatcttcaaaagattcatcttcaagttagcccttcttaatagaactgatgcttaatccacagttgtcagcccacagttcttttattttgacttttttttttttttttttttgagacggagtctctcactgtcacccaggctgctgggcagtggcgtgatctcggctcgctgcaacctctgcctcccgggttcaagtgattctcctgcctcagcctccttagtagctgggaccacaggcgcatgccatcgtgctcggctaatttttgtatttttattagagacagggtttcactatgttggccaggctgatctcaaactcctgacctcatgatccgcctgccttggcctctcaaagtgctgggattacaggtgtgagccactgcacccggccttattttgccttctttaatctccatttgaacatacacatactgatgaaaactacaacattcttcaccaaaaatctttgggatttaatttcttcaaccactttactttggggtcattttaagattaggtgtatctgcctggttctcaatttgacaccctttctctctaaacatgaatgagttccaatcatatttattcctaagctatcacactcaaatatactacagatctgtggaatatgccaaaagttaaggtgaaaaattaaattattaggtatttcatagttttgctagtttttgatctgtgagtgaatataactatcctctatgtcctggcactgttcctcagaaacatagggtccacatatgtaattttaaattttttaataggcacattttaaaaagtgaaaaaagaaatctattttaatgatttgaatccagtgtaaccaaaaattgtttcaacaaggtatctaatattaaaatattgagtttttactttgttattttactagttctttgaaatctggtgtgtattttacacttaaagcacatcacagtttggagtagccacatttccaatgcttaatactcacatatggttagtggcaactatcttggacaggacagcttttatactctgggaagacacaagcaaatacttgctctgcagcagaatccagatgttttccaagaaaacactttttctgacctgttcctgaaacccaggtagtgtctctaatactttatattttattggtttgtcctattgtaaccacccaacgggctctccttgtccacttcctagacagagctgatttatcaagacaggggaattgcaataaggagccagcgctacaggagactagagttttattattactcaaatcagtctccttgagaatttggggaccaaagtttttaaggataatttgattgtaggggaccagtgagtcgggagtgctgcttggttgggtcagagatgaaattatagggagcctaagctgtcctcttgtgctaaatcagttcctgggagtggtggggtgggggactcaagaccagataatccagtttatctatatgggtggtgccagctaatccattgtgttcagggtctgcaaaatagctcaagcattgatcttaggttttaaaatagtgattttatccccaggagcaatttgaggtttagaatcttgtagcttccagctgcatgactcctaaaccataatttataatcttgtggctaatttgttagtcctgcaaaagcagtctggtccccaggcaggaaaggggtttgtttctgaaagggctgttattgtttttgtttaaaagcaaaagtataaactaagctcctcccaaagttagttaatcccaaactcaggaatgaaaaggacagcttggagtttagacgttagatggagtcggttaggtaagatctctttcactgtaataattttctcagttatgatttttgcaaaggcagtttcactgtccacttcacctcacatcaggcctctgactagaggattccaacaatacttaggccaggacaccaccatgtctccttatccaccctgagggagtccaatttctgaaacaaaggaaactatatatgatagtatgaaactatatatgagaaggaaattatatatgataatcaattttagggttatcttattgattagaagatattaaagtgtgacactgcctggcaatgatatctgctggtagtaagaatttggcgaatttagtgaaattcctgaggctgaacctccacttctgtaaaatggagacagtgagataatttgccttacaatgctgaagtaagaattttacacaataattcagaccaaccacttcatgtggtacttggcccgtggaagactatcaatgacagttagtttatagtttatactattaatgaatcctttgtttcattgttatttccttctacacgttggcctctctaaaagaaggtaatattcaatacaaataaagttaaaacagcttgcagagttgtcccagggaactcacttaaccactgaagtgttcaaattgcttaaggttgactttatattctcctgactaacctttctccttctggtatttcttctgagaacagcaccaccatccaaagcatcatgcaaacagtggtcatcccagaccagtaattctcaactcacagggtgctcctgcagagatgtatttgaatagagtggtaggatgctgaagaaggccacgtaaaatttggccagtgatctggggcagatttatcctgaagctaatgaaacacaagtgtaagggcctgtacttccaaggtgcagagaggggccctacaaatgtgttagtttgtctctctctctctctctgattttaaaatttgcagtattaaggtactttaatcacggatggttcaggctgctattttcactcaatcctcctttttattaaaatcaccattgtctgattatgttagaatcctgatgaaaatatttggaatttgagtaagagaaagtttagttgaagatgtatctagtatggggataataagttacgtgatttgcatatgtgatcatgtgtacttcattcgttgccagccaatctgacgtaagaatggcttcaaggaggccgggcgcggtggctcacgcctgtaatcctagcactttgggaggccgagacgggcggatcacgaggtcaggagatcgagaccatcttggctaacacggtgaaaccccgtttctactaaaaatacaaaaaattagccgggcgtgttggcgggcgcctgtagtcccagctacttgggaggctgaggcaggagaatggcatgaacctgggaggcggagcttgcagtgagccgagattgcgccactgcactccaacctgggagacacagcgagactccgtctcaaaaaaaaaaaaaaaagaatggcttcaaggaatgttcctactgctcactggaataactcacctaaattcctggcaagatgcaggtctagataaaatgttatgacatctaagtattcaaaacacattcccagcactgagagtgagtgtctagtggagagtagaaacgtatagagccagaagctagtctggaaagaattcttacaaagtttacaacttacatgtgaaaggagcttaacagaggattttccaaatttgaaaacaatcctaaaaacttacttgacattaccaataatgtgttttgaaactgaaatacttctaagttatgaagaaaacatattatcatcagccaccctggaggaaagattgaattctatttccattacctatagacaacattacaaaataatttcgatctgaagatggaatcagagtattcagtcaaaactacaggaaaatatacttggtagtgtcatattcagaagttaataaaatatgctattttctgaattttgtgatggctgttgttttgtcagcttttataaaattggaatttgattttattttcccattataaatttatatttacagtctgcagtacttttgcatttttaattttacattatagtttttaatagttaacaagttgtaaaaggtttgatccccagaaaaccttgatctaccccatcagttaagtatactaatatatttagaaaatggatgaaatcagcatttgaatatttttaaatatttattaaaagaggacatgggtaaaagagctttgcagttgccacccttcattctcaaattccctggataaggatgaccgcataatctttggatggtcatacgcaagtcttgtgtacttgttacataaatctatttagtggacttttggcagtgtgtactgaggccagtttcttccacctgagctctgactccacctccagcagcccaaaaccaatactgaattttggggtcagctattgtttttgtggacttaggtaactacacacacattgtctttatgatagctttaataatactgccatcagaactaaaattgtcacgtggattaaaaggagtgacggtggtgtccccaggagcctttcaatatgtaagtatttacacatatacatgctaaaaagacccctaggaattttttaacaagggcaaaacagtaactcagcttgttttctcgcagtaaaaccggttgaaaaggcctgatagacttgtctgcagttacaaaacttgtgtgtagttatcacctttatatctcctggaaactaacatagacaaccgaatgggttacaactgtttttaagtgaaattgtgagtggctctgaaaagagccttttcaatgaggaagaaacgggcagacttatgccctttccccacggatgcgacgtgccagctggatatctttgggcatgatggtgacgcgtttagcgtgaatagcgcacagattggtgtcttcgaagagtcccaccaggtaggcctcacaagcctcctgcagcgccatcaccgcagagctctggaaacgcaggtcggttttgaagtcctgggcgatttctcgcaccaggcgctggaacggcagcttccggatcagcagctcggtggacttctggtagcgacggatttcgcgcaaggccacggtgcccgggcggtagcgatgaggtttcttcacgccaccggtggccggagcgctcttacgggctgctttagtagcaagctgcttgcgcggagctttgccgccggtagacttgcgagctgtttgcttcgtacgagccatttgcaatgagagcacacacaaaagtgtagtgaactgagagcaagtggcctttaaatatagtgagaaacattctgattggtcctgtaatatttcaaaagtcccgcgcgataaaatcattggctgaagagtgaccagactgattggttcattactagacaatcttattggatgagttgccccaccgcccatcctgtccttttcgtttcagttatctgcagcgacaaattgtctaaaattctagttcatccagtcccaaagaacagagtgtataacaaggtatctaaggatttttaaaatgtaaattccgattcagtaagtttgagtgggacttgaaattctgcattcctgacagtctcgcaagttatcaatgctggtgaacactcactaaaccaccagaaacgttcagactcatgtcgggaaataacgcttatattcagagaatgagattccatgctattttgttactggcgaacagcaagtttccttgccctttgttttctaagtccaagtcacattcccaccctgcctgttctcaaaatgtcttattttggttggccttaagtttcactttgtatactctaaaatgtactttctaaaggaaggtgttattttctcgaaacttaactttttaacaccattaggctaggggggcggtggctcacgcctgtaatcccagcattttgggagggcgagatgggacgatcactagaggccaggagttcaagacaaccctggctaaaatggtgaaaccccgtctcgcataaaaatacaaaaactagctgggcgcggtagcagacgcctgtaatcccaagtacacaggaggctgaggcatgagaaccgcgtgaagcggcggggtggaggttgcagtaagccgatatcgcgccgctgcactccagcctgggtgacagaactagactgtctcaaaacaaaccaatccaaacgaaaagcaaaaaataccctaacagaagcaagttatcatcctttcttgtgtaactatggacggctctgaaaaatgccgtttcaagtgtaagctacgttttctgatttgagtgtttacttgaccttggccttatcgtggctctgttattttggcaacaggacggcctgaatattggacaggacgcctccctgagcaatagtgacgttgcccagctgcttgttgacctcctcgtcgtttcggatggccagctgcaggtggcgggggatgatgctgcgggtcttgtcacgtatggcgctgcccaccagttctaagatctcggcggccaggtattgtaagtacactggcgcaccggctccgaccggctcaaaataattgccctttcgaaaaagatgacggactctgccctattgggaactgcaagcccggtagcgacgaacaagtttttgctttagctccattttccacgtccgcaaatagcgacctatgaaagcagcggaaaactgtgaaagacaagcaagctggaatggcgcctgaacaaatccttttatacaaactgcaaggctgcaataggaagctatcctattggtcaattatgtttggtgctttatccaatagaaaaagataacataaattccatatttgcataaaccccacccctcagtgaaaccgtgtttcttttgtccaatcagaagtgaggaatcttaaaccgtcatttgaatctcaggactataaatacatgggctctgaactgttctctgtactactctgtagtggagagtgttagtagcttttctattctgtttaggaatagcaatgcctgaaccctctaagtctgctccagcccctaaaaagggttctaagaaggctatcactaaggcgcagaagaaggatggtaagaagcgtaagcgcagccgcaaggagagctattctatctatgtgtacaaggttctgaagcaggtccaccccgacaccggcatctcatccaaggccatggggatcatgaattccttcgtcaacgacatcttcgagcgcatcgcgggcgaggcttctcgcctggctcactacaataagcgctcgaccatcacctccagggagattcagacggctgtgcgcctgctgctgcctggggagctggctaagcatgctgtgtccgagggcactaaggcagttaccaagtacactagctctaaataagtgcttatgtaagcacttccaaacccaaaggctcttttcagagccacctactttgtcacaaggagagctataaccacaatttcttaaggtggtgctgctgctattctgtttcagttctagaggatcaactggaatgttagcgaagacaagttttagagccaaggttaacttggacggggccgtgcgcggtgcctcttgcctttaatcccggcaatttgggaggccgaggcgggcggatcacgaggtcaggagatggagaccatcctgcttaacacgatgaaaccccgtctctactaaaaatacaaaataattagctgggcgtgatggtgggcgcctgtagtcccagctactcgggaggctgaggcaggagaatggcgtgaacgcgggaggcggagcttgcagtgagccgagatcgcgccatggcactccagcctgggtgacagagcgagactccgtctcaaaaaaaaaaaaaaaaaaaaattaaaaaaatatgaagttttgaagcagaaattattttgtcgtatgttctttcataaattttttgcctgcctgccttcttcctttgttacagaactccaacacttacccaaaggtagctgttgggtcagggtttctgtactatagtcccttctgtggtggccagaaatatgttacaggaaagaggtccccatccagaccccaagagagggttcttggatcccgcgcaagaaagagttcagggtgagtccgcagtgcaaagtaaatgcaagtttactaagaaagtaaagtggtgaaacgacaactactccatagacggagcaggacattcccgaaagtaagaggaggaaggcatccaccctaggtacaatacttgtatatatggggagatgtgctctgctacaagtttgtgataaaggattaattttcttagttactatattttgcaagaatcaacattattatctttaaacaaaattaagaatgcctttgttctccagatatagggatatctggacactcctaagtctgagtctgtttagtaaacattatttatttgttcccttaaccgtaaacatctagaagctaggaatgactgactttctgggaatgcagcccagaaagtctcagcctcattttcctagccctcactcaaaatggagttactctggttcaagtaactctgacacttttcttctctttttttcttcttttttccttcctttattttttattttttatttttgaaataagaaatcaagaatacttgatgtttcatctaaaacaatacccataattgataagccaaaacaaaaacctaggtcttctaactcaaaactaggatgttttgctgtctctgctgatactcggctgatcgttaataggtaattaacaaacaagccttgctatgtccccctcagtttattaccattagatcatatgcctactgtcaatcatattaatccacaactatgcatttcacaaaacttgccataaaaattcacaggtttcccgcttccctcgagttttcatttccgaagggtcccatgtaatataaaacttatattaaatacatttgtatgcttttctcttgctaatctttttttttgttttttgagactgagccttgctctgtcacccaggctggagtgcaatggcgcgatctcggctcactgcaacctccgcttcccaggttcaagcgattctactgcctcgccctcccgagtagctgggaccacagatacgtgccaccatgccccgctaatttttgtatttttagtagagacagggtttcaccgtgttggccaggatgttctcaatctccttacctcgtgatccgcccgcctcgtcctgccaaagtgctcggattacagacgtgagccactgcacccgaccaatctgtctttttgtagaggggcctcaagcatgaacttactgatgggtgagaaaaacagaattttcttttcccctacaatataaacattaattgtaatgttatcattcaggacattttggtgaccaatcttacagaaattttatcttgtgcaagtctatgcaaaccaatatgtaaatcttctataagtgagattgtatttcacttttctagtatccttttaaattaataaaagagattctaatgattattttcattactgcatttcattgtagggaagtagataattgccctttattcactgaccttcgctttttaaaaatttaaaccatgttaccatgaaaatgcttttcagtatttctctacacacaagattgctgtaagggcaaaaatagagataggaatcatgcatccattgatatacatattttgatttttaatacatgttaccaagttgcctcctgaaggtctgtttacactctcaccaacagggtgttttttcctgacttccacaaatgctcttgaacagtgggtgtgttagtctgttcaaattgccgacatgaacaattaaatctcattgttgtttttatttttaagacaattattgtttgagactgcacattttgataataacatttcttctattatggtttgattactcatgattcttgcccattttcttttgggatgttgccttatgtacattattttaaatagatagctccatgtattaaaagattattaagtttgagggcttatgatatgtcagttacatttctaagattttttttttttttttttttgagacggagtttcacacttgttgcccaggctggagtgcaatggtgcgatctcggctcaccgcaacctccgcctccagggttcaagcaattctcctgcctcagcctccccagtaattgggactactggcaagcgccaccacgcctggctaattttgtatttttattagagatgaggtttctccatgttggtcagactggtctcgaactgccgacctcaggtgatccacccgcctcggcctcccaaagtgctgggattacaggtatgagccactgggcccggccacatttctaaattctttataagtataaattcattcaatcttcaccaaaactcaatgaagtgtgagtactattattatcattgttttacagatcaaaacaagtaatacagtcacttactgagttctatacacctggtaatttttttgtttcgttgttctatcaattattggggaaggggtgttgaaatctctacctttaaatcatgtatgtgtctatttctcctttcggttctatcaggttttgctacacatattttgcagttctgttatttggtgcatatacatttagaattgcttgtttttcgtattggattgaccctgttatcattatgtaatatccctgtctgttcctagtaattttctttgctctgaaatatacttatctgatatatcatccaaaagaccaccaggatggctaaagagtagaaaggagagatttactggcaatactaatttgcaagccaggaagagatggtcccagaacctgccaaaattactctctctttggggagaaggagcaggttggttatttttatgcctcataggctatatattacacaatagagtcatacatatttagcacgtttggggggacagctatatatattatgaggggtgccaagtgcattcacaatggataaacacgtgtaatatacctcccatgttcacttcgaggttaaattttggttaaaatgaggtagaatttaggtctttacatcacaaggtgaactataggaacaaagtttacgtgctgcctctagcagctggctgaaaatggcttaaggtctacaattacgtgtaagaatagaatgtgtgtcaaggcggtcctctgtccaatcagagttgtagtggactggactgtaaatcagagttaggagggcttctgatagctcctatagttaaggaatttagcaagtgtgagttttttggtagtctttggaatttaggaatttgccatgccagccaagccatgaatgctctaccagtaggtaactttgtttgcttaatcttagagtctgtcttagttggtataggggcatctattttggtctttcagatcccagatattattaatacagatactcttgcagttttgggctgatgtttatatggcttatcttttttgcagcctttaatttcaacctgcgttatgtttatatttgaagtgagattcttgcagacagtgtacagttgttgtttttttttttttgagatggaatttcactcttgttgtccaggctggggtgcagtggcacagtctcagctcactgcaacctccgcctcctgggttcaagggattctcctgcctcagcctcttgagcagctgggattgcagccatgcgccaccacacccggctaatttttgtatttttagtagagacaggattcaccatgttgcccaggctggtctcgaactcctgacctcaagtgatccgccagcctcggcctaccaaagtgctgggattacaggtgtgagacctcgcgcccagccaaactgtttttttatgggtgtatttataccacacacatttaatgcaattattgatatcttagggcttaagttcatgaagggtagtgtgggaaccatagtctcttggcccactaaatgtttgccagaaatcactgacaaggcagattgattaataggtgaaaaggcattttacctattgtttaacgtgtctatgtgggagcattcagaattaattacctaacttcccaatgagttatagatgcttatataccatttttagatcacagaaagaattggggcttagattctggtaaaacaggttatgggaggcaaaagaggtttggcttgcaaaggtggccttgttaggtaggtgaagcctccctcagaaagaacagatggtaaatgtttcttttatgatttttaagtgtcagactctcagtctctcctggatctggggaaaggtatagaaaggtgaggaggcatggctgcattaatggagattctctacagatgtaaaatttttcccatttaaggcagctttgcaagcccatttctgcctgctggccaagcagcagccatttcaaaatatgtcaaagaaatatattttggggtaaaatattttgatttcctttagactggtggccttataagaaaaggaagagacacctgagctgacacacatacccttgctctctcaacatgttatgatgcagtaagaaggccctcaccagatactaattccatgcccttagcttcccaggttctagaacagtaggaaataaatttcttttctttaaaagttagccagtctgtggtattctgttatagtatcacaaaatggactaagtaactatattatgatcatcttacatgactgatccctcctacatcatacacatacacaggccacatttggaacattgttagaggttcctctgcccagtacaaatgtactacaaattatatatgtatttttaaatttttgagtatcttcaatagtatattttcgttaacttttgtagtcaaaatgtcattataacatgtattcaatatgcataattattagtcagatgttttacattctttcttcatactaagtgatatggtttggatatttgtcccctctaaatctcatgttgaaatgtaatctccaatgttggaagtgaagcctggtgaaaggtttttggatcgtgagggtgaacccctcatgaagcgcactcttcagggtaatcaatgggttctcactttgagttcacaagagatctggttctttaaaagagtgtgacacctcccccatctctctcgctcagctctcaccatatgatatgcctactccctcttcaccttccaccatgattggaagtttcctgaggacttgccagtagcagatgcctgcaccacacctcctgtacagcctgcacaaccgtgagccaaaaaaaattacttttctttataaattagtcagtttcagggattcccttatagtaatgcaagaacgaactaacacactaagtctatttcatatttacagaatagctcaatctgaagtaccctttttcaacttcacagtagctacttgtagctagtgggcactgatttggagcgtgttcaagggtgaattgtattatgcaattaacagattttttttattgttttcgcaaaccacgaggcatagattgtcttactttctctgctcctggtgttggagttgttattgggaaacaacttattttcctcttatatttatatggaataaataacccccaatatttccctccccaatatctgccttttgtatgttttttgaaggcaagtgcctagaatttactgtttttgaagcacttactgaaaggattgccatcaagttgttttgctaatagtacatgccaggcgcttgttggtttgcttaattcaaggtaacttggatgagaagaagagtttttctcatccatggctcagtggagtatagattactgatattgtgactggatgtactcctgctttctagtctgagtttttgaagctacccttaatcttggtttcaattttatctagccctgtacatatccaaggctctttccaaaatggtctacgatttgtttaggaagttagaatagctgtactttctgaaccacggttcctgacattttctggacttcaaacacatccagcattttatcgaagtatttatccttcctacttggctggcttcttccttgccttcaggtctgaattcaaatgacattctcctgatgaaactttccatccttatttctattcttttttcttatcccctttctttatttttctccacagcactcatcacttatctctacattttcattatgtatttaccttattgtgcacctcccactacaagacaagtagcaccgtaaggaaacaggttgtctgctttttcactgctatgctccctgcacctagaacactctctggcacttagcaggttttcagtaaatatatgctgaactaataatgctggatatacatctccctcatgaactctctaaatccttctaatttacattgatcaatcttcttttccatgtgcttttgtatgatttattgctcaaaatctttattttatatgcagaacgtgcactgctatttaatcttcatgtacgtaagtcctcccttctctgagtataatctcttcagggcactatctgagataactttttaacatctccatcatgaatcttgtaccttttcaaagaaaatgagccagtgattactgatgtttacggctattgttgagggtgaagatcattataattttgaaaagggaagttgaatattgtgaagggaaagataacactagagtcagaagacttgggagaaggcaaaaaacaaactaaaaatgagcacttttagtctcctgacagtttctctgaatcaaatccatagttctgtgacagcgttggcttagaagcagattttttttttttttttttttgaaatggagtttcgctcttgcccaggctggagtgcagtggcacgatctcggctcactgcaacctctgtctccagggttcaagcgattctcctgcttcagcctatggagtagctgggattacaggctcccacaaccacgcccagctaattttttgtatttttagtgaagactggggtttcaccatgttggccaggctggttacgaactcctgttctcaagtgatctgcccgccttggcctcccaaagtgttgggattacaggcatcagccaccgtgcccagccaggagcagatttttttacactcatgtttctttttccttctgtcatcctgtttcagtataagcagaccacagatagaagtagtagatacctcagaaattcctggaataattaatccacgttcatctgtactccatctgctcctatctcatggaatataaaaggaaaaacaccaagatttccctaggcaatctgtcttgattttaggttcctcaacaggagagccagacaatggctgtaataatattgtcccggccaaggaaaaacttcccctttgccctcccaaggtttatggaaaattactggcaaaacacagattaactggagaaaaggcatatatatttatttcatcacaattttacaggagattttagaattaagactgaaagatacaggggaaattgcccatttttatgcttaggttcaacaagataaacagctgtatagggtacgatctaatgctaacagactgagtggggaagccccgcaaggcttgtctgtcaagattcttcttgacctctcagtgcagcatttcttccttctggttataggacaagactctcttttagaatggggggtcttatgacctacaggcaaacaaggtaggttagagtaatacttttaggttttatggctggttctagggaaaaggagttctggtttgtatggcctaccttgaggaggaattctggtttctatggctagactttggggagaatgggacttacagacaggaaggcagaaggtggtcagtgaaacacttttataatcataatcccattttgagtatttctgtgttatggaatgtttgttctctcatttcctgaaagattccagagactcctcattcagtgttgtgaaaaagttcaggaaatgcaactcaaaaatgtgccactttgttacgctgatttctttgaactgagggcacctaggaaacagtaaattcaaggaagggctttcgctgaactctaatcaaaaatttgaaaattaaaaaaaaattcaaaaaggaatttagttgttaagattcacttccctggggaatctcatcaaccagagaagattaactgtatcacaggagaggagactggtggttaacaccatctaaacagactttgtcacagctgtcacctattctttgaaacacccatttatttttctccaaaatcatatactctcccctaagttgcctacatcccccttctttctcccttatgaatcaagagagcttataagcttctacagttcactgggatttggggtattcgcttttcttccctcccactccccctcccctttttttgtctttgagacacagtcttctggctctgtcgcccacgctggagtgtggtggctctatgtgaactcactgcaacctcctcctctcgggttcaagcgatcctcccacctcagcttctcgagtaactggaactacaggcgtgcactaccaagcccggcttttttttttctttttctcccccgtttcttttttggttattttactggagacagggtttctccatgttgtccacgctggtctcgaacgcctgacccgccgtcctcggcctcccaaagtgctggtattacgggcatgagccactgcgcccgatttgaaggacctcttaaatatctatttagaaattggtcggagtccactcctttccaaaaacatgagtcacaatccgggaaaagcacgagcggctgaaagtcaaaataaccagaacaaaacctccactcatgcttaaaaaaggtattttgacaaaatcctaattcggccaattattattagtattcaagtcgaaggctcgtcaagccagactggggattgggtcaaacataaaccttacaccagacggaaggattacatgcaaatgaaggatgcagattctgatttcccattgggtatttgacattagccaatgggagaattcctcacagcctacctccagtcagtataaatacttctctgccttgcgttctaatgtagtttcattacattttcttgtggcgattttcccttatcagaagtagttatgtctggtcgcggcaaacaaggcggtaaagctcgcgccaaggctaagactcggtcttctcgtgcaggtttgcagtttcctgtgggccgagtgcaccgcctgctccgcaaaggcaactactccgagcgcgtcggggctggcgcgccggtgtatctcgcggcggtgcttgagtacctgaccgccgagatcctggagctggcgggcaatgcggcccgcgacaacaagaagacccgcatcatcccgcgccacctgcaattggccatccgcaatgacgaggagcttaataaactcttggggcgtgtgaccatcgcgcagggtggcgttttgcctaatattcaggcggtgctgctgcctaagaaaactgagagccatcataaggccaagggaaagtgaagagttaacgcttcatgcactgctgtttttctgtcagcagacaaaatcagcctaacagcaaaggctcttttcagagccacctacgacttccattaaatgagctgttgtgctttggattatgccgcccataaagatgtttttgaggtgtttttaatggctttgagtgtggcacttttagtaatttgtcctgcagaaattagatccatagaaacctcaggaattctaggtatgtgggagaagtgccatgcagcacaaaacatgtttacaggggtgattcgcgttaagtttcacacacagcagttactacattttagaggaaggaaattatacccatgagtgcattcctaactatcttgaatggaagtgttaaaacccgcatgccccacacaagtttgaatatgtcataccatttgctgtagcaattaatggcatacacaattgagagcacacacattaccactgaacatttgagtatgtatttcccaaaatgagcttttttccagtttggggatgttttgctttgttttggggtggagtctccctctcgcccaagctgcagtgcagcggcgtgataacagctcactgtaacctcgaactcgggctcaagcgatcctcttgacagccttctgagtagctgggattacaggcgagagccgccacgcccggctaagagcatttttctaattgcccacacttcttatgcgacacccagaaaaatacaattttaaataaagcgcatatgcaaatttccctaatcgtctccaatattctctgatttcttttttatattttaactagaaacaattggaggtttccgcgttgctttgtgtggttgtaaattttaagacttcaggaaacttttccagtacaagacttgtccacagtggatatagcagctaaggggttaacaaaatgacgtcagagtagctacggtaatgggcaggagcctctcttaatctgcaaccaggcacagagatggaccaatccaagaagggcgcggggatttttgaattttcttgggtccaatagttggtggtctgactctataaaagaagagtagctctttcctttcctccacagacgtctctgcaggcaagcttttctgtggttttgccatggctcgtactaaacagacagctcggaaatccaccggcggtaaagcgccacgcaagcagctggctaccaaggctgctcgcaagagcgcgccggctaccggcggcgtgaaaaagcctcaccgttaccgcccgggcactgtggctctgcgcgagatccgccgctaccaaaagtcgaccgagttgctgattcggaagctgccgttccagcgcctggtgcgagaaatcgcccaagacttcaagaccgatcttcgcttccagagctctgcggtgatggcgctgcaggaggcttgtgaggcctacttggtagggctctttgaggacacaaacctttgcgccatccatgctaagcgagtgactattatgcccaaagacatccagctcgctcgccgcattcgcggagaaagagcgtaaatgtaaagtcactttttcatcagtcttaaaacccaaaggctcttttcagagccacccacttattccaacgaaagtagctgtgataattttttgttgtcttaacagaacaaatttctaaggacccccccggaaagcattagactatggtcttaaagttgattaacagaaataacggtttggtcagtcttgcagtgtaggttatttctgaccttattaaggtgctatttggagagaagctgtgtaagtccactatcattcaggcctctagcttgctatgattagcatttgtttaaacaactttgtaagagtaagggaaaaatctggtaagtagttaactggcgcttactaggcatttttgcaaagctttgaaaagattagaaaattgtgtcttgcgagttccagtgtcttcctcaaaatgcttaggaagattttctcagctcaatacatagtcccctaggttttctcatatattatatatatatatatatatatatatactgttaaattcatttggctgttaacattaacctgaaatttattctggtgcaaaatgtgaggcagggatctaactggctctcattttatccatagctagctacccactttaaatctgtcagtctgtcgaccaagcataatttaatcccttatatatgaatttttatatgtgtggctttgcttgtaaatagtctatctggttgcattgctttgtctcctctaggactatgcaccatgacatgccacattctttttttcagtacttcttgcctgtagttattaaaatctagaatttacaagttttaaccattttctttctgttgatcttgcttttcggttttggaggttggggattgagtactggaagaaaatttagagggatgggaatactgtacgcaaacaaaagtaatatttactttaaaatttttatattttgtatttttttatcatatagcttttacatcacattttacagactaactttagaacaaccacagaatgtccaacattaaaactactaattccaaagaccttgcctcacattcttttttacaataaatattttttacacctaacattctttcttggcctacatctagaatgtaaactgatgtaccatactaaaatcgcctgaccaactgtcaacaacaacaaatcacacacacaaaagattaaatttgaattgcatcgtttacttaaattcatttgtgttccagcttttaataaggcagtttttggtttataaagtaatatttgcattttaaaaattatgaaaatgaatatgtcagtttgttttatgattcgtttttcttgactcttatacaagcgactctaactggcatagacatttgttatccacagacagtatagatatgttagagatgccaatggacttggtctatgccaaggtgactactcacaagctctgggcccagctgaaggtcaagtattttttttccagttatagatgtgctggatctgatgtatagcgcttgactttttatattttctttatctgtaggaaacaaatgtgttggaggtactgggtctgacgaatagcataaaagaataaagttacattactgtctgaggatcagatggacagggggtggtagctcagtccagctattttccactccctcacttacattctttgccccctcctcaacagaacaaggattctgctgtaactcttcattgacagttgatatttaaaaattaacgaatggatgaaattctcatttgtgaaagaaaatttattgagcattttgtatttgtgagtagtgcaaacattttaatattatattaagaatctattgttttgtattagaggagtaattaaggagagattggagacaaaaagggggtgttgtttgcagaatataccatccaaaaatagaccactgtgggatcaggattcttttgagctaaaggcacttcaaaaacagcattcaagaagggaattcttctaaacttttctttctgaaaacaggagataaaagttccaatgtgaaaaatgctctgcttgtaccaggtgaaaagacatattcttcagcccagaggcatagatgagataattctgcacaaacacagcagggagtcatagccgagagacttctatacacaaacaaaccttgttaaaataatcatatattcctttaatctcctcatatggtttactttcccacaattgcctctctttaacttaatgtgaaagcatttagcttttgccatttctttggggcttcacttttttatgagggttctcctgtcccataaaatttacattaaatacatttgtatgctttcattctgctaatctgttttatggcaaatgaattatcaggtccagctggagaccctaacagagtagaggtaaaattttgcctccctacaagatagagattgtgtgcattaaatgttgtttgttcccagttgttcagtttgtcaggcctctgagccgaagctaagccatcatatcccctgtgaactgcacgtatgcctctagatggcctgaagtaactgaagaaacacaaaagaagtgaaaatgccctgttcctgccttaactgatgacattaccttgtgaaattccttctcctggctcatcctgactcaaaagctcccccactgagcaccttgtgacccccacccctgccagccagagaacaaccccctttgactgtaattttccactatctacccaaatcttataaaacggacccaccccatctcccttcgctgactcttttcggactcagcccgcctgcacccaggtagaataaacagccttgttgctcacacaaaccctgtttgatggtctcttcacacggacgcgcctgaaacagtttaacagggtttttcctgcccagtcacaacaaagtgatgttatgctgcaggctgaagtttacagctaatgctgttgaagtctaaaatcagttttggtttgttagatttgggtgagatggctaagattctcagagaaagaagtcaagtttggggtgcatttttcagacttaaaaatttagcagtagcccttgcagtttttccaatagaagtgatttaagaatgttttcaggaaatttaaaacaacagtgagaagcgtgtatggagagttgaactacactccagacttggctataggaaagcacgaatgctgctattgtattgcaccttggaaaagagaacaaaggaatattttcggacaattttaacatgtcacatatgaaaagctaaacggaatctgtcaacaccttgtacgttattacaggctgtgattttaaaaaaacaatccttactaatacatacatagttgctgctagcaatatagtgttgggagtaaaaacacgaaaatgagagttcaggacaatatcccaactctgagcagatttttttaagtagtaacatctaaaattaaaccatattatgtaatatttatttcttttccacagtctcttctcatgcctcgttcacattagctaattaaaagtcccctgagtatcatcataacccgatttacagatgaaggcacggttgcaatgagctatcaccctcttctgaatgagacagtacagtgtgaaggatagcaaaactccactcccatcctcttagggctctggctggaccagcaaattaaattaatgtaaaatggattaacaggagaaaggtatatgcatttatttaacacaggttttacgtgacacaggtgctctcataaggtaatgaaagcccaaaaaaagcagttagctacttatataatgaattggacaattagtaaaatgtaaaaatgcgctaaagcaaagggatttaggctagaatatataactgtgtagagaagcgcccagcaagggctagtgcaaggtttgtacagaattctcttggcctcagcctcctatccttgagaagaatgttgctttttttaaactacagtgagaacatctttcatatgagaatttcacctactgcttctaagaaacaggtcagctttcaagaaaacataaggccagagtgatcttttcacgcctgctcttttaagtacctttgaatagtcaatatgtcttcaagcacttgaaagacttaaaaagtttaccactccggcatattagtgaaagcccttaatataagcccttattaaaattctcagtcgagggtataaattcagattcaaatagtagtgtcgtaaacgggagggaaaaactaaagggattaaaaagtgaaactattgtgttctccctcgcagtccttaggtcactgcccctcgaggggcggagcaaaaagtgaggcagcaacgcctccttatcctcgctcccgctttcagttctcaataaggtccgatgttcgtgtataaatgctcgtggcttgctttcttttcgcgtacctggtttttgttgtcagctggttagacatgtctggtcgcggcaaaggcggtaaaggtttgggtaagggaggtgccaagcgtcaccgaaaagtgctgcgggataacatccaaggcatcaccaaaccggccattcggcgccttgctaggcgtggtggggttaagcgaatttccggtttgatttatgaggagactcgtggcgttctcaaggtgtttctggagaacgtgatccgggacgccgtgacctacacggagcacgccaagcgcaagactgtcactgccatggatgtggtttacgcgctcaagcgtcaaggacgcactctgtacggcttcggcggttaatcttttcgtcagttttcttccaatggcccttttcagggccgcccactccctctcagaaagagctgtgattgtattctttcggatggtaacatctcaatggctttactcggctattctgcctagtatgtagaactattataaaccagttgggagagaccaggttgtttggtctgagtggctgctaaagcagaaatcagctaagtaaacgaggtctccgagataagtgagctataaacttcaatgctatagttttgacatgtcaagcaacttaacgtgcagcgcgagtccgataaatgagtagctcagctttttagttttaaaaacgagttgtgcgttatttgtacgagagcctaagatgctagctgcctggaactgagtaggtggattaaaatgggtgtcaggtctgttttcccaggcgtatctgacttaacgtcagcaaaagctgtacttttagcttccctggtaacacctgccgtccttaaccgccccctgccggtagcgccagaagcctttacttccatttctagttgagcttggcgtcctgctgagtgacgtcacctcccccttctctggagtaggactggcggttaaagctgctttgctattttcagtcctcaggctggaggctcccctaagcaggctgcctacgcagttcgtaaattcccacttagtagactaagggagtctgttttataaataaggactcaaatttcttctgactccgaggtccgtggcagcagctataagatggaagccccctctgatgtaagattctcagatgacttgcatcttcactgtacctgtcaacccaatagtcttctattcctgccttaaattgtaaattccaaaactgatttaattgtgaaagtttcaaactgtacgacctaggaagtgtcaaagttaggtgaccagatttttagaagtcagccaaatattcagcatctttgatttagtaacaaatatattgatggctacttcagcaaaaaaaatcaactttgttttctggttactttgctaacaagcttctcctgacaggaggatatagtgaataggcagttgaataagtgagttcgggtgagaggtctgagctggagataaaaatgtgtgagtcatcagcagataaataaatgctgagaccagatgagatggctaaaaactgaaacataatgtagtgcagcattgtttgtaatagtaaatgagtggcaactgtaaagttttcatcagaaaggactagagtgatctatacatccataaaatagagtatttctctacacagccctactaaagaatgagaaagctgtactccactacatactctggtgtactctggctcagttcttggactcctcttttcttggctaactcaactggcctcaccacttacatgctctgtgctctgtcaaatagtttgttcaacagaacaccacggcctagctgtaagtgccacgttaacttctagcaatgccaaagcctgtgatagtggcagcttcgggctgtttctcattcccgggatgcctaaccacctctccaaattctatcagtttgcttccacccacttcaagcttcagaacgaaacatagagcttaagaaatataggcccggcaaggtggctcacgcctgtaatcccggcactttggaaagctgagcctggtggatcacctggggtcaggggttcgagaccagcctggccaatattgtgaaaccccgtctctactaaaaaaaaaaaaaaaattagctgggcatggttgcgggcgactgtaatccaagctactcgggagggtgagacaggagaatagcttgaactcgggaggcagaagttgcagtgagttgagatcgcgctattacacttaggcctgggagacaagagtgaaactgtgtctctaaataagtgtttgcaattataaaccatctccctgaccttaaatctctagactcatatacaactgcatatttgatgtatctaattgaataatgggcatctcgaacttgtccaaaatatgtttatacgtaaacaccaagtctgttcttcctctgatatttgtcatgtcaatcaatagaactccattcttcaagcagcttgggccaggaattgtgcaatattgtttgtcctgagcttcttacaactttcacccaatgcagtcagctctgttgaaaatcaatcagaatacctttcattgttttctttgctgcttctctaggagcaagctgccatggcggtttgtctgaatgaccacagtgaccccaaactggtctttgttttcacttttaatccccctgtcatacagttttttctctatccagcatcaacagtgatcctttttgaaggtattatgtccactgtctgctgaaaagattccactggctttccatcaccttcataataaaaaccagcatccttatcatagcctacaagtaagatgaccaaccattacagtttgcctgactctcaggggtttctcagggtgtaagacttacagtgctgaaacttagaaagttccaagcaaactaggatgagctgctcaacctactagatctgtactctggctaccctctgacctcattctcttcgcagttctttctcttcactgaccttgctgtttctggaatggaccaagcatttccagcatcagcacctttatatctattctttctccctagaagggtcttgtcctggatatctgaatggctctagatctcatttcattcaagcctctcctcaaataccaaccttacgaaagagacctcccataatcatcccttgtaaaataagcttttctgctcatttagcatatatatatatagttgactatcctcaatagcatatatatataacatttccccacctagaattatatatgtaataatatatttaacaaaaaatacatataactagatatattttattttgtgtttgttctctctcccccaactggaatatattttttgaaggtagggactttgttttgtcccagaagtatccctagcaccttgaacagggctgacgtttaacaggtagtttatggaggtttgttgaatgaaaggatgtgtgaattttctatgtaagtctccaggctctccactaagcccaccagaatgctaacacaatcaattccccatctcattccttgacctgccactgcctgaagcaatcagcgtgcagtttctctttagaaaatctgggggatagtctaggggttgcaaattaagcaacattatctttgttctgaacaaggactgcatgagtgttaggactgaagaaggcccaaggtggtggtgggtatgcctaagatgagtatgacatatcagcaatgctatgaacatagcaatgctatgaaaggccaggcaaaacgtaacaggagctagtcgtggcttattgttacaacgactatacctcccatatgggtaatcgatatccacacacccctctacattgactctggaattcaggaaagggaattaaaattttctaacttatgtaccccaatgatttcaacaatatctggcatatgagatcaataaatatctttaaaataccaactaagaaagacataaaatgacccaccctccataccaggctcatttttgctcctctgattcctgaaactatccagaatgcagctatgaattctctccattgtcagttttaaattaagccaagctgggtacttgtgtaattcctcaagaaatcctggatgaaaactgtcaggtggaaaacaggacctcaaaataaagagacatccatcactgaagctaacatcgtgaggctgaaatcagtcctataacaatggtaccaaaaagagcacaatgagaggcatttgtgaatatttactcagatgagagtaagatatttccctatcagctaacctgaagttcacatcccttttccagctgagttctgaagctagatgtacttaactggaacacataactgcatcaggaacatcctttaaaactatggctaccatggcttgactggacaaaccccaggcttccaggtttagcacaggtggcccttcacagaccaacattgcctatgctaccaacctcatgtcctaccaccctgcttgcatcatttctctctctgcatatataaaaatatatgtgtatgtatataatcagctttattgatatttaatgtaccacaaaatttgcccactttaggtacagttcaatgaattttaccgtgttttcttagttgtacaaccatcatcacaatttaatttcggaatatttctatcacccaaatttccatttctgcgtaaagggggaaaaaaaaaggttaactgctgaaggccgcggtaacactgaaaaaggtgccttttctctctaaaacagattttaatctcccctgaatttagtgtcctgggtattccaggagtctgaatagggtttcaattttcagggtctttttaatagagtaaaactgtattggtggcgataaatttagtattgctctcagtacatgattgagggatacttaaatgtctctgtgattttatttcataatcgctaaaagatggtttttttttttcctaaaacagggtttttgttttttctcaataagcttcttagcttcccctccggctccctggcttgcctcaggaaatattagctcatcagttctgattggttgacagctacgaatggccctcattgattgggcagcgcttctttgtcccttggaaactaatacaaatttttaacactactttttttccactctttcttcagagttggaatatcgttgctcccctacccatatgtagtgagtggagggcaaacttggagttcccctaatctttcctttttaggatgtcagctcagtatcattcatcttaattacacattgagcttcttgacttaatggatacagctcttcttttgtttagttgggcggccctgaaaagggcctttggttcagaaatgcaagctgtggagaaatcagcaaccttaaccgccaaagccataaagggtgcgtccctggcgcttaagcgcgtagaccacgtccatggcagtgactgtcttgcgcttggcgtgctccgtataggtgacagcgtcacggatcacgttctccaaaaacaccttgagcaccccgcgagtctcctcgtagatcagaccagagatccgcttcacaccgccacgccgggccagacgccggatggccggcttggtgatgccctggatgttgtcacgcaacaccttgcggtggcgcttggcaccccccttacccaaacccttcccgcccttaccacgtccagacatgacttcccaagaagtgaaccaagagcaagtgagagaataggaaaccgatctttatatatctacgttacccctgcccccacctccagcggacactgagactgaaaagcgcgcaggcgggaaatgtgacgcctacagtccgctcctttaacccctcctccaagccccaggaaatggcgggagcagcgattgggggagggtggggagatgagggtgggaccaagcaggcttgaccaatggcctttattttcttaacagagctacaggctttgaggaactgggttaagaattaaatgtaaacccattctgactccagaattattttaagtcgaactttttttttaaccgaatctctctgtcgcccagactggagtacattagagccatctcgattcactgaaacctctgcctctcaggttcaagtgtttctcctgcctcagccttcagagtgtagctgggattacaagcgctcgccgtcgcgcccggcgtgtttttgtatttttcgtagagacgggattcggccatgttggccaggctgatcccgaactcctgatttctggtaatccgcccgcctcagcctctcaaagtgcttgaattacaggcgtgagtcaccgcgaccggccgaaatcgattggttttgaagccttcagtagcattaaaacgaaaagtgctcccaatgcattcccttttgtcttaaattggtttcttacagctactttacttgaaaaggtggtggctctgaaaagagcctttgcttggaccgtcagagagaccacagtaatcacgccctctctccgcggatgcggcgggcgagctggatgtccttgggcatgatagtgacgcgcttggcgtggatggcgcacaggttagtgtcctcaaatagccctaccaagtaggcctcgcacgcctcctgcagagccatcacagcggagctctggaaacgcaggtctgttttaaagtcctgcgcaatctcgcgcaccaggcgctggaaaggtagtttacgaataagcagttcagtggacttctgataacggcggatctcgcgcagagccacggtgcccggccggtagcggtggggctttttcacgccgccggtggccggagcgcttttgcgggctgccttagtggccaactgtttgcgtggcgccttgccaccagtagacttccgagcagtttgcttagtgcgagccatgacggaaaaacagcacagcggaacacccaacactagcgcaaatacgcccatgagctgctctatttatagtgtgtaaagtgcagtgattggatgatagaagacgctaaatatgacgttacacactctgattggtctatctttaagccagcaacaatcgtgcagtttcaccggctactatattctattccaactctacagatgattatttaagtggtattttattactactattattttattttacttttgctttgttccccaagctggtcttaaacttgggctcaaaggatcttcccgcctcagcatccagagtagctgggattacaggggagccccactgcgccggcttggactttaattttttaaacttgtcctcttctacatctggttttcataacctgaaggctgtgtttattttccataaaacaaggcattgattccaaaggtattataattccccaattccgtataaccttcagctctttaggaaaaaaaaaaaaaaaaaaaaaaagagggaatactgctcacctcctctccggaaatgtaccctttacgggaatttctgaaacctttcacaagaattggattcctttgtaatgctttaattgacttaggagtgttattgaaatctacaaagcatctcaaacatagtaggattacactattactcagaaacattttctatgagacgtctttctcttgattatgctctttgaatcctaaacttgcagcgttctgcagcttttgttttctaaagcctaggtgtactctgccagtcacaaaatggcgtttctccagcactgccgccaggtaccaccagctgggagttgttcctcttgcggagcaggaggtggacttggcccaagagaaactggatagtggttcgcaaggaacataatttagcattgccaagagctaatgcaatcattttgaaaatctcaaaacactgaaaagtggattgtgacctttttaaattcacaagagacaggccacattctatcttttgattggtttaggctattttcttgaacagccatttagaaagcagatctatcatccttcatttgcatggagcgttcccattttatttgaaaccagtttaacccaatagaaaaaagggaggcagaacccattatttaaagtggaaactcctgaatcagataattaggagtatttccttttcaaaagttgcgttttttcagatacctcgcttattacactaagaaaggtttatatctttcacaaagggtttacttacaaaaatcttccaattttgtatacctgtgtttcataactgactagccgtcaaaccaagatgtagagtttccaaccgttattttccaaatttttagaaattacgtgaaatatttgaatgcatgccttctcaataaaatgggacgtaggaagcactggtgcagaagatgggtacaatacttatctgggaccactccattatttggttggcacgttgtttgaacaaaaaggggaaaagctcaggttacttagcatggttcggacttatttgaaaactaccacagcaggagcggaaataagaccgcattacctcactctctgctgtgctgtgctagggggttatccagaataggattgtagaagtggatgtcgatttaatagttttttattctcccattagctgagtctctgattggcaatgtgagatcgttttagcttattgatactttgaaatgcacttaacagccacaaacaagttaaagggttgttaccataaaatcttatccccagggtgtgcttgcatttatcacccgtgtttgctttcacactaagtggacttaactccccagcagaatgcctgtcagggaaccggtttcgtggacccagcatttaacgcctttcgcaggcttgtgaggcccataaatatttgttgaataaaagaatgagttgaccatgtcatggtgcgctgattgcgtgtgctgacatggaacacaggttgtaaaccttaataccaatttggggcatgttgtatggatgaaaagggcattggaaattcctgaagtgcatcccacattggactgtggaaataagttgcaagtgcagaaacgtttccacacttgcagtttgagtattaattgcagcgtttgtgaattctggtgttgtctacgattcattcttgtttgacgtgaaaggtattcgcgagacacatcgctctaaaacattgccagaaaatgtaatagagttgatgacaactggccctaacacggcctaaaactcgcacttttctctccctccgcaactattcaaaacactgtattttacatttcttgcaaattaaaaactaacatctctggcaacggacctctaaaaatttctaataaaactcctcggatgcttgtggcactgcatttgtaaaccgccccctctcaacctactccctaaaaaagagctgctttttgagagagaagcggtaccctctgatgttactgggcggcagtctgcctacaatttccttcacaatgaggcaaccagagcggctttttctgtgtgtttgcttgcgttgaggggagcaggaccataggccctagaggcccccagctgccttctgagactgggcgaaaccctcggcagcgcgcagggggcgctagggcgcgaggggcgggcactgacgggcaccaatcacggcgcagtcccaccctataaataggctgcgttggggcctttttttcgcatcctgcttcgtcaggtttataccactttatttggtgtgctgtgttagtcaccatgtctgaaacagtgcctcccgcccccgccgcttctgctgctcctgagaaacctttagctggcaagaaggcaaagaaacctgctaaggctgcagcagcctccaagaaaaaacccgctggcccttccgtgtcagagctgatcgtgcaggctgcttcctcctctaaggagcgtggtggtgtgtcgttggcagctcttaaaaaggcgctggcggccgcaggctacgacgtggagaagaacaacagccgcattaagctgggcattaagagcctggtaagcaagggaacgttggtgcagacaaagggtaccggagcctcgggttccttcaagctcaacaagaaggcgtcctccgtggaaaccaagcccggcgcctcaaaggtggctacaaaaactaaggcaacgggtgcatctaaaaagctcaaaaaggccacgggggctagcaaaaagagcgtcaagactccgaaaaaggctaaaaagcctgcggcaacaaggaaatcctccaagaatccaaaaaaacccaaaactgtaaagcccaagaaagtagctaaaagccctgctaaagctaaggctgtaaaacccaaggcggccaaggctagggtgacgaagccaaagactgccaaacccaagaaagcggcacccaagaaaaagtaaattcagttagaagtttcttctagtaacccaacggctcttttaagagccacctacgcatttcaggaaaagagctgtagtacacagatgaaatcccccaagcaaatgcaacacgccctcaattatattagaatcacttggagagtcgatagaactttaacatagcctcatctagtaagaatttactactcaatctatcaaagatagcaaggtgaattcaaatgcaccgagttaaaatcgagttttaaagtcacctgggtttcggtagccggaagtcccgcgtctcacgactccaagctaattagtcataaccgtattgaaccaaggttgaagcccagtcccaggcttgaggctttttattatacaaggttaaagtggggatattgcgttttggggtcaatattgctaaagtagcattttccgaaattgggtggtcctaagaaatgcttctgggatagttggcaaaatatatggcttaaccacgccctctccacaggagtggctagcgagctgtctgtccttgggaaggacggtgaccctgctggcgtggctggcgcccacgttggcgtcctctgaaagccccgccaggtaggcctagctcgcttgctttctgcagcgccatcatgacaaagctttgaaacgcaaaatgctttctttgtgcagcgccttaccatgggtgcacttacgggctgtcgacttggtttaggcccttgtcaggacaaaggagcttagtttgttggagttttagagctgcaacccaaaatcccttgctcggtttctctgtttttagaaacggaagcgccctgattggatatttgaaaattactgtgcttaactggatcgtgtttcatcagtcgtgcaggattttcaaccctggtggagcccacacattcaaaactgaagatccttttctcagaactgcccctttaagcttttgcaattttaattctgggggtcagattttaataattggacttttttgtttacatctgacaagagtatatgatgagccaagtttactcacttttacttagtgcagttcaattctaaaagtttatttttgcgtgtgtgcatatgagttaataatcagttgtatttttcaaacggtcttttttcaattgttttgcttagctccttccatcgtctaaagtcagggatacaggcacatcacatccctgttcccccttcctcaaactaatatgtagctacctaggtttatcctttaaaacaaaaattctcacctatttttgtgagaaatatacatgtttttctttgaactaagtattttacatacacctatctatatacatgcatacttgtggttttgtttttttaaaaaaaaaaaaaaaaaaacacgttatcttttgagactgggtctcagtctgttgcccagactggactgcagtggcataatcacagcacactgtaacctccaactcctgggctcaggctatcctgcagcctcagcatccggagtagctgggattgcatgcacgcaccaccaagccgggctttttgtttttattttttgtggagacagtcacaccatgttgtccaagctggtctagaaatggcctcaagtgatcatcgacctcccaaagtgttgggattacggtcactgtgcctggccttgtatgcataattgttttgtcttttgattagggttattaatttaaaaaacaaagcctggacgcagtggctcacatctgtaatcccagcactttaggaagccagatgggcagattacttgagctcaggagttcaagaccagcctgggcaacatggtgaaatcccatcttgacaaaaaatacaaaaaattagcaaggcccagtggcacgcacttatagtcccagctacttgggaggctggggtgggaagatgactggaacctgggaggtagaggctgcagtgagcagagatcgtgccactgcactcaagcctaggtgacagaatgagacccagtctcaaaacaaaaataataaaaattttttacaacgatgttatatacacttctgcatgttgcttttctcttaaccaaacttttctaaaaccctgtcatgaaaaaagaaatccttcacatggaatagcataagttattcatccatttcttattgataagcattgatgtttccagttaccactgctgaacatggtgcaattgaatagaattccagggctgagattgctaggttttaggttgtattttattattttatttatttatttatttatttagacagagtcttactctgtcacccatggtggagtacagtgccatgacctcagttgcaacctttgcctcctgagttcaagcgattctcatgcctctggtctcccgagtagctgggattacaggcacctgccaccaggcctggctaatttttgtatttttaggagagatggggtttcaccatgttggccagactggtctcaaactcctggcctcaagtgatctggccacctcggcctcccgaagtgctgggattacaggtgtgagccatggcgccagacctggactttgtcttctgtttcatcagtccttctgttggttcaagcacagtatcacactgaagactgatgattctatataaatatggtaaagactgtacaccctaactgttcttattttttaattttaaggcaattttagattccagctttccaaagaattgtggaatgcttagagctagagaagccttggaagtcatttagtttttgttttgtcagagaaaattctgtagagactctgtcctgctctcactgaataccatcccatagtaccccccaacagctttaaagggcaataataccttatggacagtatgcttttcctcaaatatattctaagccatggtcaatgcaaaagagtgagaaggaaagtagaataagttatctaagaatcagtgggtgctctctttaaactgatttatcactcccccttccaaactctcttgaaggtcactctgcctccctttctacataagaactcctaactccaagggaggaaggtaagttattcttattccttgcttagaaaaagagaaaataggtttggtaagcatccgctttctgctaccattctctgtgtttctgtgttttttataggatcattcaattattggttggctcttgagagggaatgcaaggttcaaggacacaagcctagatcttgcctgtatagaacctcatgatgttatgcttctctaaaatgaggcctggaggagacatgttgaaagtgacccataaatctgcagtatctcatgtctctcaatggggacaaggagtaccatgggaaatagcattaggtcaatgacagtaacaactcccaggtgagttgatttattcttttatttataaagttgttaatatgctacatagtccctaattttgccacaaatagtcattattttaatttcatatttcactattgataaatgaaggaaaaaatgagtagcagttaagcagtccataaacctacatataaagcaaattggagattttaaaattgattctggatgcttaaaatccttctcattgaaaaaaaatttcgtattagaagatttcaacattctttaaactgagaagcataacatataaacagaaaaccacagcaaaacaaaaatgcaaagctcaataaatgaacacaaagtgaacaccataataattgccacacaagtaaaaaaacagaaaatcagccaaccctcccagagccgcctgatgcttgcttccagtcacattatcactccatctgccctaaacataacccctattttgatttccaatgctgtaatttagtatgcctgtttttgaaacatataaaatggaaataaaacaaatgtaatcctatgtacctgacatatttcactccagaacattaggtttgaatagattcatctgtgttgctgtgtataactttaattcatttttattgttatgtaatattccatgttatgagtgcaacaatttaggtgtctactgttgatgcatatttgcttccctttttcagctaatataaacaataccgtgaatattcctgtgtatgtgtcttggtatatataggaatacatattttgtttgtatacctaggagaggaattgttgggtcaaatgctaaactctttttgaaagtggtgatattaggtttacatgcgatgaaatgaaaattaaaaccacagttataaacagcatggatgaacctcacaaacctaatgttgatggaatctagctgggaattcctgttcttccatatacttcccaatatttttttccaattaaaattgttaatcttttgaagatgttatccattgtggcagatgtgcagtattatctcattatggttttattttacatcttttgcccattttttcttaattggattgtatatcagtcgacttgggctgccataacaaaaatactagactaggtagcttgaacaaaaggagtttattacctcacagttctaaaggccaggccagaaatcctaaattgaggtgccaagagattcagtttctagtgagggctctcttattgacctgaagatagttgctgtcttagattgtttggtgctgaacagaataccagagaccaaataatttataaagaatacagatttatttcttacaattctggtggctataaagcctatggtcgaggggcccacctctggcaagggccttcttactgttatggcagatgtgagatgtcatctcatattcaaaccacagcagtcgccttttgtgtcctcatgtggcctcttcatatgcccataaaatgacctcatgtctcttccttttcttataaggacaccagatctatcagactactggcctactcttatgacctcatttaaccttaaatatctccataaagtcccaaaatccctatctccaaatataggcacattgggtgttagagtttcaacatcaattttgggggaacacaatttaggccaaaaagattgtgttttttcttgttggtttaagatagctgtctttttgtcctttttgtcctttctttttttttgaggtggactcttgctgtgtcacccgggttggagtgcagtggcgctgtctcagctcactgcaacctccacctcctgggttcaagaaattctcctcctcccaagtagctgggactacaggtgcataccaccgcgccctgctaatttttgtatttttgatagagacggggtttcaccatgttggccaggctggtctcaaactcctgacctcaggtgatccacctgcctcggcctcccaaaatgctgagattacaggtgtgagccaccaaacctggcctgtcttttctgttttaagtttttaaattttgctcacgaaccctttatccattttatgtgttgcaggtatttcctctgtaacttgtcttcactctgtcagaggctggagtgcagtggcacaatcacagctcactgcagcctccacctcccaggatcaagcgatcctcccatcttatcctccttagtaggtgggactacatgtgcaggccaccatgcccagctaatctttgtatttttttgtagagatggtgctgttgcccaagttggtctcaaactcctgagctcaagcaatccatcaaccttggcctcccaaagtgttgggactagaggtgtgagccaccactgcacccagccaatgatatctcatgatgcattaaagtcattaatttagtgtactcaaattaagcacactgcccttttatgcacaaccttttttgtatcttatttaaaaaatcattttctatttcaaggtcatgaagatcttattttataataccttcttgtgaaattagttctcaagactaccctcacttctaacaccaattataagttgggaggtctgtggttcccaatcaaccttaggttagtaatttgctaaaaggactcacagaacttgctgaagctgttagcctcatggttacaatttattataggatatatagcttattatgtcattccaatgcaatgtaaaattatacaactacttttaaaaagattttagcatttgacccaacaatttcactctgaggtatacaaacagcagatatgtgtgcacatatataccaagacacatacacagcaaaattcattgtttgtaatagttgaaaaggggaaacaactcaaggaataaagattaaaatcagctgagaaaagaaacacacaaggcagtattatggatcgaattgtatgcagatctcccttgcccccagaagatatgtttaaagtcccaactcccagtacctcagaattgtggccttatttggaaataggatagttgcagatataattagttaagatgaggttatagtacagtatgatgggctggtgacttagaagaagtagtatatatatattttttaatagaactagtattcttctaaggtggtcacgtgaagacagacacacacaggcagagactgaggttatgcagctgcaggtcaaggaatgtcaaaggttgccagcaagtacgagaagctaggaagagtcaaggaaggattttcctacaggcttcagtggaagcatagatctaatgataccttcatgtcagatttctagcttccagaactacaagagaatatatttgttgttttaagccaccctagcttctagctctttgttacagcagccctaggaaactaatataggcacaatccaggcaagttccaaatatgagcttccagttgtcctctcccagtaatatgaacagtattactttcccagcattaatgtgtgacaatacacatgacgtacagagcagtccccacttatgcacaaaacatatgttccaggacctccagtggatgtctgaaaccatggatagtactgaactctatatagctgttttttcctatacagacacagctatgataaggcttaatttataaattaggcacagtaagagattaataacaataaattagaataattgttaagaatatactgtataaaagttaggtgaatgtttatttctgaaatttaccgtttattatttttggactgcagtagaccacaggaactaaaaccatgtagaaaccgtatacaagagaactgtatttcacccgagcctcagtgtgcagttttaatggcctgccatggttgactgctcacatggccgatcttttagtctacctccacaggtagagctgatactgtgtggctcaaagttcctattataaatcacattgttgactgtgtggtggtcaaaacctccaggtaaacaaagacacacttatcagtgagaacatttcaagggtctaaaattcatctcccagtagctgagggcaaaggctagacctctttttgggtaagataaattttttaccatatactttattttgcttttcatgtttaactttattttgcttttcatgttagttcccctggaattgttttttgtgtatagtgtgaagtagggggtcaagtttctttttttttcctttttgttctttttctgtttaaaaggctatacaattgtcccatgccatttatttacaagagtcctttcaccattgttgtatggtgccactttagatgtaaatcaatgtccatatttgtttgagcctgttccattcgtttgtctatttttggacaacactgccctgattattgtcattttatcagttttgatatttaataaagcaacagatttgtttattttgggcccttggatttgtgtattaaatttgaaccctgtttgtcaatttctataataaagcttattgggaatctgattaggattacaatggttttgtagatcagtttggggacaattaatacctttaaaatattgaccgcttcaactgtaaatatactcctccattatttagttttcctgtttaatttatctgagtaatacattatagttttcttcgtagaagtcagatacgtagaaaattcaaagcccaagtgcaatagctcatgtctgtaataccagcactttgggaggccgatgtgggtggatcacctgaggtcaggagtttgagaccagactggccaacatggtgaaacctcatctctagtaaaaatacaaaaattagctgggtgtggtggcgggcacctgtaatcccagctaatcaggagactgaggcaggagaatcgcttgaacccaggaggcagaggttgcagtgagccaagttcctgtcactgcaccccaccctgggcgacagagcgagacttcgtctcaaaaaaacaaaaaaaagaacattcaaataatcaatgtagataattcaaataactaaaaaatgaacagttattaaaatatcaggatataaaagcaaaaaaatcaataacctccatatatacaaaatggccagttagagaaaaaaaaaagaataggcgagacttaaaaaggctgggaatctccctgaaaatctttgagagccttggccctgccctcagggatttctctggcttcatgcccagatacgggtacagttccttgtttaaaaaaattttgctccatcaatcaacaaggggctccttcctcagagcacaaggacctccataacaccggacactagatgtctaagggacacctcttaaggaagttagacttccaaagaatggtgtttcctctgtccccaaactctggaactcacagcacaactgctccttggagttcggtttcaaatctacaaggctgtcatggaggttgcagaccaagtccgtggcctcagtgtccggatgtacggtggccttggcacctgaatgtgagaacatgacctccctgaaaccaccacaagtattgtttcatgttatgtatgttttttcttatctgaaattccttttctttaaaaattcaaattacatattttgcaagcccctgaacaagcttcatgagcatttattgaacccacagcttttaaaacctactgaacactttgctctatgttgtcattcactatccaccaattatttaattattgatcaatattgtttccttagtgttgggatcatttatgcatgtatttcttttatattgcatattttatatttctgcattacagttattacatattacttttgctacagtaatagttcaaaagtgtacatccaaaatttagctgtgaagtggatggactgaggcagaactggaggcaagaaaatgtcacagtaattctaaaaaagatgatgtacaattagagcaagagagtagcactgaaattgaagaaaaatagatgcgtttgagagaaaattaggaggtagaatcaacagattagatgtagggatgagaagggtcaaagatgacactagggtttttaactggagcaagtaggtagacagaacatttcttcctgaaagggcaggtcagatcatgtgttgtctcaaagggcatgaagagtagaaagcctgggacagatcctgagatgaccaatacccatggtgcagggagagggagggagatctgctaaaaagactgcaaatgtcaggatagtagaaaatcatgagtgtgtgatgtcctggaagttgagacagtatcacatttgagaacatttaaattggtaactctgacaaaaagctggaggccaactgtgaatgcccatgagagtgagaagctcccacacttttgtgggcatcagaaagcccaccaggttcctgcagtgaagatctgagaaggatcctcttgtggctttggcagggagagaagaattattatgaaatacaccccagaaccttcttcaaaacaaaggcctactctcaaggggaaaacattttgccagagtcttatcccagctgggagaaggtaattcttcccactgcagcctcatctaggctttctgtctcacttaagggaagaaaattagtcaacagggatcagagcttcatgaaaataaattggaaatggtgcagccaggaaaggagcaaaggtctgaggaggaggagaaggaggaagaggagttgtatcattataaatacttgaggaagaggaggagaaggaggaggaggaggagttgtatcattataaacacttgaggaagaggaggaggagaaggaggaggaggagttgtatcattataaacacttgaggaagaggaggaggagaaggaggaggaggaggagttgtatcattataaacacttgtgacggtcccagccccaagatataggcatgctaataaactgaggcttaacactttgactacagaatgctgcttctccctaacaccatcaaggctccaactgaataacaatgaattatgaatgaaagagctgtaaggagagacaaaagttagaatgagacaagtattgttatctagagatgccaagaaggcaaggaagataactaaaaaggcactctggatttagaaataggaagtcattagtgaccttgtaaataatggagccagaggaataccaagggcagaagcctcactatagtgtgttgcacctgtcagaggtcaggaggtgtaactgactctcccacagtgtggctttggaagagagaagtcagcagctgcatggagatttgggagagggaaagctttttttttttttttttaattggaaaagactgagctatgtgtaaatagaataagacaggaagagtgtagacacaggaaagagggcagacaaaaacaagtgcacagttatctaagggaaacaatgggatcaagctgcaagtatataaacttgtcttgatagaagaatccttgatctggtttattcagtgtttggtccaaacccacatccctgttctgcctgtctctgacttgctctgtgccccagaagcccagcttctacagatagcattagctgggcagccctgccctcttgcaacagctggatttggccagtgatcagcccagcaggaatgtagatggcaaaggagagagaggttagtgtacttattccctgcatcacccccctgcttggtgggcagctcttcctccacagtcccagctctggcctagctctggttacaggttccctcccattgcctcttcagatttaaaggtgtgtctgtcagggtataactgggagctagaaattgcactgaaattgaacaaagaattttatgggaatggttgttaactagttataagaggactgaaaatggaaaagtggacaaacgtatcagagatagtaatgacagaaagcaactaccacctccaggtttaggagaacaaggaaaagattctttgaagagatccccagaactgggacctctgaggagtgtatgctggaccactgatgatgatatgtctgtagatagaggcatgatgaggctgattttaggagcatggaagatctccaaactgaagccaactgctgttactggattcaactgccactgccaggttgaagaacccattctgtgaggatgtcaacaaacaaagtgggaaatcttttcacatccttccagccctctagtcttcctccagtgctttctattggtagggtttggggaggtggctagcaaagcggtattggaaaagatagaagagactaaatcttcataaccagcacagggtgacactggatcactactgttgctgatcttgggctgcctcatatcccctgttcttcccattagccctgtcacaactttgtagatatcccttcattatatgcccttcatatattcttttggtttaactttttctgttggaatcctaatatggcactcctccatttttcaggaccaaaagagtataaaagattatcttttaccaaaaaaaagacaaaaaactgatctaattcctgatttgatcattacacaatctatacatgtatcaaaatatcacatagtaccccataaatatatacaactgtgtccattaaaaataaaaattaaagaaaagatggtaaatatagctctgtcaggcagtggaggttttaccacgatggctgttatttcccccatgaaggggggagtgagggagcagctgaaagtaggtgcttataggggtatagaggggctcaaagctttgagagaggagaatgtctgaaagagctgccaaatagcatgcaggtcccatgggggcagagcctctgctcattcaccagtgcctcttcaatatctacacttaagcctaacacaaagtgtgtgcttaataagtatttgctgagtatgtaaagtggaaacagaaccaatctggcaaactttgtaggactggtgggcaatgaagatcagtcaggtaaaatctgtggatataaatttatattgatcaaaaaattcaaggttaggtgtttttcttcagtcatgctcaacgatgcttcagccatgctcaactcttctgtagccacagaaaaaagtttacccataatcgagctgtgtctgtgtctgaataatgaaaagaccatgatgcaagggagttggagacacagaaacagtgtttgaagtaatgggtaatggaagcatgctaccagggaaaggaaagaagtggcaataggaaggaacagagatctgtggtcctatgtcccctgagcatattcacatgttaaagctaattcagttttcaatcatcattaaaattttgttcctaaatatatggccattattttccacaaccacactaaaactttattacctctggcaagtgactatgcaagtaactaagagcaaaaatatccacaactaccatttgagctatcaatttagggaaagtcatctggctataatctaagtgaccctccactgaatgtcagtatctttgcatatgtgatttaaatctgggccttcgcaacaccatgaactgttcttgtcttgaatatccagattgaaggaaataatctgagtagttacgagtcctgaagctagaaagatggaaaccccatttgctcatcagaaagccttagagcttgggcgctggcgggtcctgtctcaccgggacagaggggctctttcctccccatctgatagtctgataactagagaagccggccaacttattctccaagaaggagccatcttagttcctcctgaaatgttcatatttagaaattattgtttgtcagtaatttaaccccttaatgggcttgccttgtggtccataccactgagtgcagagcttgcctggaagaattgtgagggccattccatcttccaggcagtagagttcagtacttctttaaaattgctgctgaactctgtatttgaaaagaaagaatcatttgggtgtggtagctcacacctgtaatcctagcgctttgggaggctgaggtgggaggatcatttgatgccaggaggaccacttgagaccaccctgggtaacatagcaagaccctgtctttagaaaaaaaaaatacaataaaataaatacaataaaaataaaagcaaaaagaaagagtccatcttagggacagactgtaactactcactggagcttacctttacatagttcaggatcaattataataaaacacttttgtgcagattcaataggattattttaatccccatcatctctctgagtttccagtcagtttctctgcatgtagacacccttctccagcccaccattgtctctcctcctatagctccaccaacaaatcagaactttttctaactgcacctagtgcacctagagtctactccagaatgctcatggagaaagtttctgaaaggtaaaactctgaatgatatttgtagctaaagggagacttgctagagacaataagctaatagttgtagacttcagtagaagaggaatgacactgcaatgtcagggtgcaggacttcaagagggcagagtatggaaacccaatgggaaaaatgctcaccaggaacatgaagagaaggaattacgtgtaaggatttctcaatgtgttcccaaatttgcccagcagagggaggcctcgggttgatggcaggctgaccacacaattaaagaaggctgaacctgggggcttttaacaaccatcgtgggctctactgtaagcatttagaaaaagaaagttatccattcaaaaatatatatatttttaaacttcagaacaaaattatgaagagctatatttacttttctacattctaatttttataaatctgagtatattttgcatatattgttatagtacatattcaattttgtattttgctgttttcacttaaccatttttactagattactctgtgttcataataatcacttttttaaaacttttatttttatttatttattttttttttgagtcagagtcacactctgtcgcccaggctggagtgcagtggcgtgatcttggcttactgcaacttccacctcctggattcaagcagttctcctgccttagcctcctgagcagctgggattacaggtgtgcaccaccaagcccggctaatttttgtatttttagtaaagacggggtttcaccatgttggtcaggctggtctccaactcctgacctcatgatctgcccaccttggcctcccaaagtgctgggataatcactttttatgctgcataattcttcagatttgtcagtacgactgtatttacactcatttgttttattagaaagaattccagaatattttggctgccctaattaattttacaattaatatgattttgaaattgggtattggctccttctgaattggtttattaaaatatattctaatgtaatttatgacattttcatcatattagcatatttattctgttagaatttcataatttataaagctacaaactgtatgtgatatagcttgtaactttatctcataactttatgcagttacaagtagaaataaaatgttcccctcaagattgcttaaaattttattataaacaagtgtaaaaaacaaaatcactaaaacactccctcttttttcccccaaaatgcatgtttccattttaacagaacccgtatttaatcagcagatttctatggtggctagatttgtagactaaatattaaaagtcccaaagcaaatgcatttttctcttaaattttactgactttttttttttttctttttctgagacggagtcttgctctgtcgcccaggctggaatgcagtggcacaatctcggctcactgcaacctccgcctcccggattcacgccattctcctgcctcaacctcccgagtagctgggaccacaggcgcccgccaccacgcccagctaattttttgtatttttagtagagacagggtttcaccgtgttagccgggatggtctcgatctcctgacctcatgatctgcccacctcagcctcccaaagtgctaggatcacaggcatgagccaccgcgccccgcctactgacttttatccaaagaaaatataagagctcttcatcataacgtatgtttcttgctcttgttattaaatatgacacatttagacttaaactgatttgaaggtttatgacattgtttaagttattacataattaattcataaagataatgactagtttgaactactgacagctcacacatcatcagttgaacagcagaaagcttactaagctactttcttatgtttctgtctcccagctactaaaagaaacgaaacccttccaggtgttaaggcaaaactttcctccccctttcttctataaatctgattccatgttagtgaaatttctactgatggctttggtttcctctatagtagaatagagatcctatggcaaaagtcatgtctgacatggtagcaaatagaaatggggaaaaggaaggtctgcaagagccaatgtgggaaatggggagaggactgactacaaaaacccagcaggaattccagaagaaaactcctcaggacgggcacattggctcatgcctgtaatcccagtactttgggaggccgaggtgggcagatcacttgagtccaggagtttgagaccagcctggtcaacatggcgaaacctcatctctacaaaaaataaaaaaatttgtcaggcgtggtggcatgcacctgtagtcccagctactcaagagacttaagtgggagaatcactcgagccttggaggtggaggttggtgagccgagatcacgccactgcattccagcctgggcgacaaagtgagacgccatctcaatcaatcagtctcctcgaaaagcaacattatggagagacaggattccgtcaaggcctggggcacacaggaaaatattaaggcagaagagagtttcctccccacaccacaccgtatcccacaggcactgcggatgtgcatatgcaagaggggttgatcctaagaatttagagtcacagaggaggaggcaccaagcagactgtggagaaagtcatgaccagaaagggacagaatgtaaagcttcagctgattatctggcctcagggattccagaggaactggtcccaatggtctcctggtgatgtaggttcttaggtttcttttacaggggttttctgggagatcgttgacccagttagcattcaagcaacttccaccctgcacttttattctttccccttcacctgcttaggttttatctgtccaggaaataataataaaattattgagccctggacatgtacctgtaaagctccttaaagatgatgccttctaactcctcattcaacagatacaaaaacattacaataaaatgactcatgcaagacacccaggtagtttatagcagctaataaaaacagaataactataaaatatggtaagtttataaaagttacattgagtatactttataagaactgcttattgagtttgcctaataaccacacagcacaataataatatgtatatatttttaaatatgtgtaaatatgtgtaacacaaacttgtagaaggtatatctgagtacaaccctattctgtttggttaccttttctagttcattatgtaagtggcatagctacctaaggacttatgcttataaatgttactcaaaaaaatacagaggacatatgtggatagataatggaagagataagataggtaggttgaagggttgggctgcccctccacacctgtggttgtttctcgttaggtggaatgagagacttggaaaagaaagagacacagagacaaagtatagagaaagaaaaaaaggggtccaggggaccggtgttcagcatacggaggatcccaccggcctctgagttcccttagtatttattgatcattattgggtgtttctcggagagggggatgtggcagggtcaaaggataatagtggagagaaggtcagcaggtaaacacgtgaacaaaggtctctgcatcataaacaaggtaaagaattaagtgctgtgctttagatatgcatacacataaacatctcaatgacttgaagagcagtattgctgccagcatgtcccacctccagccctaaggcagttttcccctatctcagtagatggaatatacaatcgggttttacactgagacattccattgcccagggacgagcaggagacagatgccttcctcttgtctcaactgcaaagaggcgttccttcctcttttactaatcctcctcagcacagaccctttacgggtgtcgggctgggggacggtcaggtctttcccttcccacgaggccacatttcagactatcacatggggagaaaccttggacaatacctggctttcctaggcagaggtccctgtggccttcctcagtgttttgtgtccctgagtacttgagattagggagtggagatgactcttaacgagcatgctgccttcaagcatttctttaacaaagcacatcttgcacagcccttaatccatttaaccctgagttgacacagcatatgtctcagggagcacagggttggggctagggttagattaacagcatctcaaggcagaagaatttttcttagtacagaacaaaatggagtctcctatgtctacttctttctacacagacacagtaacaatgtgatctctctctcttttccccacaggaggtgatggccggaagaacatggcagagggcaaaacaaaacagcattgggaacaagctctgtttaaaaggagacttgtgaacagcaaagagtagaaagggttctcttacaactgaagcccatggaagacaaatgtgtactgcgtgagttttaaggcaataggagtagtgggacctagggcacaccagagagcatattaactctcaaacttttaaaaacattatatctgctggacacagtggctcacaccttaatcctacaactttgggaggccgaggcgggcgggtgtagcttgagcccaggagttcgagaccaacctgggcaacatggcaaaatcccgtccctacaaaacaaacaaacaaaaaacaaaattagccaggcacggtgatgcgtacctgtggtcccagctactcagaggctgaggtgggaggatcgcttgagccccgggaggttaaggctgcagtgagccatgataatgccactgcatctcagcctgggcaacagagggagaacctgtctcaaaacaaaaacaaaaacacaccatacccaaccacaatgcatctgtcttaagtaccagtaccacacccctctactcactactaaataggtgagttcccaatccctggtagcaggtttaagcatgttatattaaaggtcttaggctagtgactcattcactcattaaacaaatacttattgtgcatctactataaactaagtactgtgctaggtacaaaagcaaataatctaagctctataaactttactttcttcatcaacaaaatggagatgttttaggcatctactcatcattctgagctccatcttttgtgactgtagttggcagagctttttatcagtttctctaaatagctctaccagtccctggtggatgctggcatgcccaaaggatccatcctgatggccctgtctgcttaccttacctgcctgcctttgcagcaccgctctgctcttctgcaggacttcccttatcctttggggtcttgctgctcttaggctgctctgcttgttttgatctgctttgcatcacatgtatgtaaaggtcctttccttatttacccatgaccaaggtattatgagattctggaatttccccaaaccacattgattgctgggagaatagaagaagtggattacaagtggaacttagaaggggagtattcgagaagacgtctctgcaaatccatttagagagacctttctccagtggtgactcaaagatgcagctcctttcatcctgtggcttggccatcttcagcacatggctcccaaggatgtcctcaggatggtctctaatccaaggagcctgaagagaaaaaaaggcatggagtattgtgagtggtaggtggttatggaccagttatggaagaatacacatcacttttgcccaccttctactaaccagaactcacacagccatagacactgacaagtaggacttaacaagaatctaattttgagtctaggaatacgactgtagcaaatatttaacagcttcaaacacaggtgcattgctatcactatgcttggcccaggcctgtctccctttcctgccatgtcacaggggccagcatttatgtctagattgggttggttgggatattaagacaataatgaaccaatacaacatcttgagcataaaaccaactgatacaatgatgtacaagtcagatgattctgatgattatgaattatgtcaataaaagaaatgtgataactaaggtaatttttgttttggcaaatttttgtttgttcatgacaggatgaaatcctgtcatttgtagcaacatggatggaattgcaggatactacattaagtgaaataagccagaaacagaaagttaaacaccacatgttctcacttatatgcagaagctagctaactaagtaaataagtttatctcattgaagtaaaaagtacaacagagattactagaggctgggaatggtaggggaaagagatgataaagagagattcgttaaaataagttacagctagataagagcaatcagttctagtgttctatttgtactacagaatggcaatagttaacagtaataaataatttcaaagagctagaaaagaggacattgaatgtttccaacacaaagaaatgagaaatgcttgaaataatggatattctaattaattaccctgatctgatcactatacacagtatgtataaaaataacactatgggctgggcgcagtggctcacacctgtaatcccagcactttgggaggccaaggtaagcagatcacttgaggtcaggagttagagaccagtctggccaacatagtgaaactccatccctactaaaaatacaaaaatcagccaggcgtggtggcatgtgcctgtaatcccagctactcaggaggctgaggcaagagaattgcttgaacccaggaggcggaggttgcagtgagccgaaatcgcgccactgcactccagcctgggtaacagagcaaggctctgtttcaaaaataaataaatacataaataaatattttttaaaaaaagaacatcactatgcaccccatatatacatataattattatgtcaatttgaaacataattttgaaaaatgaaaaaatgaaacacaaatatgaatcaatcctctccaagttgatatacttaaaaggaaaaaagtccgagggcttaaactattcaatcaaaattttattaaaatgctatagtaatctggaaagtatttcagaatgaattggtataaggttagacacaaagatcagtgaaacaaaacagagaacccagaaatagattcacacatctatggacaactggttttgacaaaggtgtcaaggctatttaataagtaaaaaaatcgtcttttcagtaaatgtttcttgaacaagtagacatccggtgtgggggagaggagcaggagccttacctcaaactttatgcaaaaattaactcaaaatagaccatagacttaaatgtaaaagctaaaattataaaacttctttaaaaaataggagaaaatcatcaacaccctaggattagcaaagatttctttaaaacaaaacaacaggtttatagtttataaaacataaataacaaaatgataaatttcatcaaaagtgaaaatttgcttttcaaaaaacattataaaatgaaaagcaggaggctgaggcatgagaatcactggaacccgggagctacaggttgcagtgagccaagatggtgccactgcactccagcctgggtgacaaagtgagactcttcctaaaaaataaataaataaataaataaatagaaaagaaaaagaaaaatcacaggctgagagaaaatatttataatacatgtatctgacaaaggactcgcacctggaaaatataaggaaccttataacttagtaagatgacaagccaaaacaaagagtaaaagttttcaacagacatttcacaaaagaaaacatacaaatggccagtatgcacatgaaaagattttaaacatcattagttactagggaaatgcaagtcaaaaccacaatgagatacttcacattcaacagaatagctaatgttaaaaggactgacaatccccagggtgagcaagggtgtggaggaaactactctcatatattgtgaatgtaagaggacaatgttacaactactttgaaaaaagtttggctgtttctaacataaaattaaacacttatacagcccagcaatatttctgggtcatttctcccagataaatgaacacatgtccatactatgacatgtacaaatgttcatactggctttgtttcacaatgctataaactggaaacaacccacgtgtccatcaacaggtgaatgggtaaataaattgtaatatatcggccagacgcagtggttcatgcctgtaatcccagaactttgggaggccaagatgtacggatcacctgagatcaggagtttgagaccagcccatccaacatggtgaaaccccatctctactaaaaaattagctgggcatggtcacgggcgcctgtaatcccagctactcggaaggctgaggcaagagaatcacttgaaccgaagaggcggaggttgcagtgagccaagaccatgccattgcacttcagcctgggcaacaagatggaaactccatctcaaaaaaaaaaaaaattgcaatatatctatatcttggaatattataaagcaataaaagggaataaactactgatatatacacaaaatggatgaatctcaaaaatgtgaaggaaaataaaaaatacatatgatataaattccattcatatgaaattttaggaatgggaaaactaagctgtaattatggaaagtacatcagtggctgcctggggccaagaggatggaagaggcggcacaggtgatactacaaatggaaactatctaggttgacggaagtgttctgtaacttgattacagtagtaactgtttgggtatataaaacgcatcaaattgtataattaatacaggtgtattttactgtgtataaattattcctcaataaagttgatttttcattaaatatattatttgctaaaatgaggagagacaactattatcttaaaatagttaagcacaataaaaatactacaatcaactcattatatatggaaattaaaggagaaaaatagtggtatgattaattaaaataaaaagaaaaccttctaaattttatcttagctcatagttgtaaaagctgccatccctaaccaaggccacccttgaccctttctcatgttccatctttctgtttgtttcatagtttatgtctcaccaaaatctatcagataaacgtattcatatgaagatttaaatatattacatgttaagccttagcgaatacttcaatatctaaagaaggtacaaacaaaacaaaaatcaacacttagttataagagattacatactctccagggaagacctgaagactagcccctttctggatcccactagcccctcatcccactccaagccctcccctccaatcccatatgcactgggcattcatacaaataagaccatcagctctggatatctgtactgattgatgctcctgctaactacctgaatgattgcgatgtaaggacagcactgcctgaatcctatttatctctcgctatgccatagcggccttccatgctgatggcgtgtttgaggatccagaggggtctttggttggcaggattgttttatttccccaagaggagagccttgatgcaaaaataggtgaagaaatcagtacaacaaaacagaaagcctagaaactactatgaacacaatagagcagaagtagccttaagagttggtggagaaaggatggtctattcaattacctgggctgagaaactggctttcatatggaataaaaataaaattatagctataccccatatcatacacaaaagtttctacatctaacaaagacacagatagaaaatgttttaaaattttagaagaaaatagtgcagaattttagtgcagaatttcttagactagatgcaaaaacaaaaatgattaaagtggccaggcacggtggcttatgcctgtaatctcagcactctgggaggccgaggtaggtggattagtggaggtcatgatttcgagaccagcctggacaacatagtgaaaccccatctctactaaaatacaaaaattggtagggtgtggtggctcacgcttttaatcccagctacttgggagtctgaggcaggagaatcacttgaacctgggaggcagaggttgcagtgaggggagatggcgccactgcactccagcctgagcaacacagcgagactctgtctcaaaaaaatctaaaaataaaaagattatttttaaaagactattttaaacaaaaaaaatcgtttaaatgatatgacacactacatctaatatttggaaaagtacttcttaatacttttaataaaaagaggcgctgagagcatacaacctatcctcagaagagtgtttgacctctaggagggacgcaagcgcgttcttccttcattttaactggtcattttcatttatttcaggaacatctgaagtaaacacagtcacacgttaacctttaaaaatctaggaggtgcgtacgcatagttccattacttcaatttttgtacttttgcattttaaaatatcacagggaagctcggtacagcttcaaggctaggaggggtggctctctcttaagccctgtccccgccagccccagacctctcgtcccgcccccattgcccagtccccaccctcacttccccatttccccactcccgcggtctcttaacgcacctcgtttttcgtccagtggactcagacctgtagtcttccaccaggatcggctcctttcccggagctctcgctcttagaggaaattgagagaagcatcagcggagacccatctgtggctctccagagggcgcggcattcagaccccagatccagctgtgagaacggaccccaggctcacaccaggcctgcgggaggcggcccaccagaggcgctagaaaacaagcctcgcggggaggcgcgcagggcgactgcaagctgtagggggcgctggcgccctcacaggccaggggcagggccggcgctgcgggcggggctcctgcggcgtgaggggcggccccaggccagcagctgcgccctggctgggagccggggagcatttgctgctctgctggaccctgagtctggcggcgggcggcctcctctccgctccccgcccgccatcccccaactcccgatctctctgctgcgtctggcctcaggctgagaccccaacgaatcattccccgcatgggaacattttatgatataactgaattcagttttatgtataactgaattacggatatgagaatctcaaatgaggacgaatggtttttacgcacaaaacatgagacacaaatctgtaagaaatataaagtcgtgaccacgtcctttcagaactttaacctgtttgctgaagtacgtcagtaacaatggcagggaaagggtatcttaaatttcaccacagcctcaaagaggccatttcgtggatccgctgaggcttggagtcggccttctgaccacgagtcctgcggctatgaaagaggaagccgcggttcagggcgtcctcgcgagtcgtgcagcccgccctgctccagctggggacaccggtggtcacggcgctttccagctgcagatccaggcggcagcccaagatttggtccagccgccaaggggtggctcgagtgactgacgggccttgaacgctcccaggacccacatctggagagggaggtgggggtggggtgctgaagtcattcttggggcccctgggggcgggcatggacctgggtaaggccagagaaattgacacctcgtgacatccctggaagagaagtacgttcagtgtcactccagagctgaaaccgccttctggctggtccctcctcacctacatacttttctaatttgtctggagcaggccgggcatctgtattatctggttatttaaatatctggttatttaaaagctctccattaaattcacatacacgaaaataaaaattaaaaaaaattttaaaaaaaagaaacaaaagctctctaatgaccaagtcctacacgatagtgaataaatttttttgtgtggtccctaaaattgagttcatgccttttctgaagtaatagacgcccagagaagggatcgacttacccatcatgccacagagattaattggccccagaattctttagcagaccgtgtatatgaacgtcctttgcaatcatataaattaactgggaaaacctcatttagtatgttacatgcctagcgttttgtgcctgaacaccttacaagaaccagggactattgccccaatattatatttcaggaaaggaaggcccagacaaatggtgtcactggtccactttcacccagttggtaaatgaaaccagaaattatagctgtaccacagaaaggtgaaaacgtttcttttataatttcacatacaatctttaatggacccagtgtccaacacattaaagcaagtgctcaggagtgacatcaagatgtaaaaaatagtcctgtcctcagggagtttaggtcttggagaaaagagacccaaggagacacaagacaaaggggaaagagaaggagcgctgaagactgaggaccctgcctgtggactgaagtgaggatggggacacccgatgcccggaatatgacagtttggaggggcctgaaggactcttctattctctatcagaaaaacagaattactctcctaaccagaaaaggtatttcaatttatattttccatcacagcacttttctggtgataatttaatgtgttttaaaaaatgtatcacagtgatggcctggtgtgaaataaataataaaattttaagaattaaaaaatataaaaatcttttatatagacattaggagttacaaggataactgtgaattataattagtaattaaattgaaatactgattattttcatttttatttaattatttaataaaacctatttaacatttaatatttatcagtaattaaatctaattgttaatatttattattataaattattttagaattaaaaataagtgtagaagcgaggcatggtggctcaagcctgtaatcccaacactttgggaggctaaggtgggaggattgcttgagcccagtagttcaagaccagcctgggcaacatggagaaaccctgtctcaatacaaaaaaatgagccatgtgtggtggtgcgtgcctgtagtcccagccattctggaggctgaggtgggaggatgacttgagcctaggcagtcaaggctgcagtgagccctgatcttgccactgcactccagtctgggcaacagagcaagaccctgtgtcaatatacatatggacaaacttaaaatttaaaatgaaagcatactactgatacagaattgagtagagatgcaaagctagtcctataaccagaacaataaagataaaaaggagagtggaagaaggtatgtcatgaatttcatgataaatggcaattgcaaatatcctgtagcagaacaaaacaacaaaactgtagataaaacatatccaaccctttggaaggccaaggagggaggattgtttgagcccagaagttggagaccagcctgggcaacatagtgagaccctgtatctaaaaaggaagaaagaaaaaaaaaaaaaggatgataaagtagacaatattgaaagccattttctgcaaatacatagtgaatttgatcagtaattttcttccaacagtgcaaaaatgaatagatattagttgcctgaaataaaaatcaaatatccaacaaaaaatattgactatctaatagtatctaagctagtaaatttggccagttataaaatgtcttaaatttttatttaaaaaaagaaaaccatatttataagaagaggtgataaagagaaattatttcagttatgaagattttgttagaaaactatgagaaaaaaactattttttgttttcaaaaagtgaaagattaagttaccaaacagttgctaaagaataccagatggctgagcgtggtgacttatgcctgtaatcccagtactttggaaggccaaggcaggaggatcattttaggcctggagttcgagaccagcctgggcactgtagcaagacccgtctctattaaaaaaaaaaaaaaaaaaaaaaaagaatacaagaccttgctaacaatagcaaagatcaattaattcaaaatttgaaaaactgtaatttatttagctttagagtactctcgtgatatgagattgccaaattaatactttgggtgcatttcttttctcaaaggacttgcaaatttacaaagaagtgttgaagaaaagccacacattggcaggtaatgtttgcaaaagacagatctgatgaagaacaatatttttagaatatacaaagaatacttaaaactcaacagtaagaaaataacctgatttaaagcaggccaatgacctgaacatctgttcaccaaagaagatacacagatgcaagtatgcatatgaaaagatgcttgacatcatgtcattagggaactgcaaattaaaacaagtagataccactgcatacctagtagaatgaccaaaatttagaacactgtcagcaccaaaggttgcaaagatatgtagcaatagtaacttgttcattactggtgagaatgcaaaatgtgcaatcactttggaagacagtttggtggtttcttacaaaagtaaccatacttttaccataagattcaccaatcacactccttagtatttatccaaaggaattgaaaacttatctccacacaaaaacctgcacatagatgtttatagcagctttattcataatttatccaaaacttggaaacaagatgtctttcagtaggtaagtggataactgtggtacttctgaataatggaatgttatttagagttaaaaagaaatgcattcactttgggaggccgaagtgggtggattgcttgaggccaggagtttgagaccagcctggtcaacatgggaaaaccccaattagccgggcatagtggcgtgagcctgtaatcccagctactcgggaggctgagatatgagaatcgtttgaacctgggagatggaggttgcagtgagccagtgccactgcacttcagcctgggcaacagagcaagactcctctgtctcaaaaaaaaaaaaaaaaagaaagaaaagaaaaaagaaaaagaaaaagaaaagaaacgatcaagccatgaaaacacatgaaggaaacttaaatgtatgttactaaaaagccaacctgaaaagactgcatactatatgactccaactgatgcagggcaagcaagccaaaaattagggcttagcccgggaagaattcaagggtgaagtggtggtgttagcaacttttactgaagcagcagtgtacaacagcagaacaggtactgctccttgctgagcagggctaacccataagtaatgtgcccagagtagcagctcaggggcagttctgcagtaatatacctgcttttagttaagtgcatgttaagggggattatgcagaaatttctagaaaaagagtggtaacttcggagtaggtacagaggaaagaagtcgataatgtcctgttgttgccatggcaacgaaaaactgacatggcgctggtgggcgtgtcttatggagaggtgctttaacctcgtccctgtttcggctagtcttcaatctggtccggagtaaagtccctgcctccggagttcactcctgcttcctgcttcacaactgtatgacactctagaaaagacagtaactatggacacagtcaaaagattagttgatagaaattgggtgacaggaagtgttgaaaaggcagaacacaggatttttagggcagtgaaacttctgtgatactataatggtgaatacatgacattatacatttgtcaaaacccatagaaagcacaacaccaagaataaaccctaatgtaaattacagactttcgttgataatgacgtgtcaatgtaagttcaattgtaataaatgtactactgtggtgctggatgtctatggtggggggacatttttgcttcaatagttacagttgaagtaaatgtttgtgtttcccacaatgcatatgtagaaactctcacattcaatgtgatggtctttggaggtgggctctttgggtgatagttaggtttagttgagatcctagcagatcgagtcttcatgatgggcatgatgggactggtcccttataagaaaagaccagaaagctagctctctctttgccatgtgaagacatagcaggaaggtagccatctgcaagctaggaaagggccttcacaaagaatcaactcagacctcagaacagtgagagataaattgtcgttgtttaagtcactcaggctgtggtattttgtttcagcagcccaacctaagactgttaattggattagaaatttccttttggggatggtgtgtggcgggcggggggcggggagtacctttgttaagcttttatatcaatgagtttgtaggcttttcttttttggtcattgactaggacagtttaaatagtatgagtgtgaaggagattgttggtcatctattcgatgtcccttctctgttttttaatatgagaactcctgattttcagccaactaccctggaaaaaaagctaatctttctgacttcttaagtgtggccatgtactaaattctggctaatgcaaggcaagccaaaggttttatgataggttttaggacactagagtaaaagagagctgttgcacacatgctcttcaccctacttttgtgtccttttttccatcctacaacttgggttgtgagtatgatggctggaactttagtggctctcttggatcccaggggtaattgaggggtggctggaaggaatctgtgattttctggagtttccatacacaaacaagacctggattttctgggcttcccagacttccacatctagacttgctttaaatgggagataaataaacttgtttcagccactgtcattttgggctattttatagaacttaatctaatcttcaagggtacatgaattgcttttccttaaaaaaaaaatcagccataaaatcatcttcttttttcttttgttccccacattatttagttggagctctgtaactttttttttttttttttttgagacaaggtcttgctctgtcacttaggctggaattcagtggcatgaccatggctcactgcagccttgccctcctaggctcaagcaatcctcgtctcagcctcctgagtagctgaaactaaggcacatgccaccatgcccagctaatttcttttcttttagagatgggagccttgcccaggctagtctcaaactcctagcctcaagtgatcctcccatctcagcctcccaaagtgacaggattacaggtgtgagccaccatgcctggctgctctgtaagtgtctgaatttcattttgtatttatcagtctgtttagattttctttcccttcttgggtcagttaggccattggtttctttttaaaggttttcaaatttatttgcatctaattcttcaaattactctcaaaattattccagtatatattcttttgttcctattttcttctgtattctttattaaaatagctaatgatttatctagcaggacttatattctttccataactttcctgcaccccaattaatctccaattttatatttcttctggccttccttatagtttccacaggtttattttattcattttttaaaacttttatttaattgtttattttattatcattctttcttattcagcaatctaagtgcttagggatatagaatttcctctaagcagcatatgctaggctttaacaatgttagggaggcctcccctttctggggaagaccacacttacattaacacaggactgtgggatgccaagaggtagagaagagcttatgaatatccagattacatcttcactgatcctgcacaaaggtggggttcctcggttacccactgggtcctattacccaagtctgggtcagcataccgagactacgggtatatagaacaagtgcaactggcgataatccttctgttggggagaaaaatcttttttttctattcatcttaggttctccatctgtggccctatcaagtagactaacaaaagacagattgacaagacagaaacaaagcatgtgcattgtacaaacacaggggagtactgagatgaatactcaaaagaggatttagaacttgggcttatatagcattttaagaaaagaatacattttttaagtgacaaggaagacgaaaaggactttgagtttctagtgcagtaaattgtgggaaggcaactttttctttccctttttttttttttttttttaaaaaaaaagacttctctggtgctatgtccaggctgataagagtctaaagtctctggtgactaacttttgttcttccccgagtaagaagacaccttcacaatttcatatcctgcttttaggcaaatagggagagggcagaggtgtttgtttgtttttaatctattttttttctcaattgtcttcaactcaaaatacttcttatgccaaagatggcatattctgctacccttcacttactacttacaacccagcctctatcatcataattagaacttctgaccctggggaacatgggcaatagtttgaactcttttatatctcccttaggcagagatggaggcccagccatgcctctgacatctagacacaactgttgcttcatttctcctattctcagaggtgatgttgtaggacttcaacaaatatcagtaaacattaattttttttttccttgaggcacagcatgatcttggcttactgcagctgctgcaggctcaagcaattctcctgccttggcctcacgagtagctgggttacaggcccctaccaccatgcccggctaatttttgtatttttagtagagacagggtttcaccatgttggccaggctggtgttgaactcctgacctcaagtgatccacctgcctcagcctcacatagttctgggattacaggcgtgagccaccatgcctggccatcaatttttatgtcaactctaaattataacatttagcaattttgtgactttttatggtcatcattaatgttgtttatgttttagttgtagtcctgtcattactcactcgggtatggtaatttggtctttttcaaaatgaagttaaggtctatttgctcttctctgaatcataataagaactgccaacagccatttcagcaataactatttactgagattttaaaatatttcaaggtaattggtcctagcagactggaaaataccaaattcttttccagaactgaatcccccatcaaagttcaattttactcataattcccttttcatttgaagcatctcattgtaagccagtcttaacccttctctcacactttgcttggctgtttctcaggtagaactcagtaagtctggtagcctccaggactgccgcttagattattaaacaacatgtcagtggttggaagagtcaatgttattttgatttttctgttttgttttgttttaaatgcagttggcggataattgcagctttctttcattccctacatgagttcaaatggcagcaaacaaactaggagaacgcagaccttctgacttgtgggtacccctactcatcacctgaagacccttggaaatcaaagccctgacccattaaagacggatggagacagcaacatacgatcatcactattatcttgctttgccccagtccaggttaaccatctgtggtatttttagttgctaagtccatatattcaacataaatcaattatatatccactaaaatctcagcactagtctaactactaaggaaatgacagcgaagaaaacagaccaaacgtctgcccttatgggatttatattattttctctgtgctggttaaaccaaggagcttctgctcttttccttagtcacctgggggaggcagaaacaaaggagaatattgataaacctggaaatagggccggagagtatcagagaaggaagccttcgggaaagtaaagatgtggcagccagtattcccgttataaaaggatacaactccggcctcatagtccagaaaaattcccacaagcaggggctgctcatgcagatgaagggaagttgggggagaagtaagtgctacatagcctttctttttgcacagcctgagggtccagaatccagactgaggctcttgcttcatgccagtgcccctctgcacattttccatacaaactcctaaatcccatccggttccttcgccaacatccacttcaaagtaacgtcttcctgaggtgaagccttcacaacccaagacacaggggaaggcagtaaatctcctggaagatgtgtcctgattctcctgggtgtatccacgagtcacttgtctccgatcctcagagagaattagttcgtgatgagctgtatctggatccagagtcacactaactgcaaaacaaaacaaaacaaacaaaaataattttgttgctgtgaagaacacaggttattttattttattttattttgagatggagtgttgctgtcacccaggctggagtgcactggcactatctcaactcactgcaacctccacctcctggattcaggcaattctcctgcctcagcctccggagtaactgcgactacaggtgcgcaccaccacaagtggctaatttttttaaattttctgtagagatggggtttcgccatgttggccaggctggtctcaaactcctgacctgaagtgttccacccacctcggcctcccaaagtgctggattacacaggtgtgagccaccatgcccagccacaagttattttcaataaaaccagcctgtgttcaaacccaactattgtttcttataaactgggtgagcttaggcaaatcatttaactttctgagcctcagtttgttaactataaagtggaaattaccgtatttgttgcagagaatggtgggtaggattgaataagcttatgtttgcttaatgcttggtaaaattcctggtacatggtaaccacctaataagtggtagttgttggggtgatcaggcccaacaccaggccgtgggggctacaaagtccggcggggtcaaaggaatgagaaaagacaagttaagagtgcataaagtgggtccagggtgccagcactagattggaggctgcaaaggccctaagctctgggagcccacactatttattggtgatcaaacaaagaagcaggtggtgaggacgtgagggtaaacaggtgagggcatgaggacatgggggtagaaaggtagtggtgcattaagcgtagctgtgacagtttagcattttctttgacacatgtagaatatactctgctgcttgagatagtagaggacacgtttatgagtgaaaagcaaggaaccaacaagtctgtgcactttccagaggctatgaggggttttatgccctgagccctgggttccatccaagccacaaggggttttatgccctaggcttagatttgtggtgcggcagggcagccttccaccatttggcacagagcttggtgttccaaaggccacgaggggttttggaccctggaccccggacatcttccaagactcttttacattatgacagacaagccagtcctgcttcagctcttctaacaacatgtagtaataatgatatcatcaacatcatcttcgtcttaattattcaaggatgccaaggtacagaactaacctgttaatatggttaccatcctgtccaaagttcttctcccatgcaggacttccaggaatcatgagacagttgagcagaaagataccttttcccttctctactgaataaccaccaacattgagaatcagagagggaaaatgactcagctaatgtcttagcttgttattggaagacccaggtctcatgacacatgcctagtcccatgacttttaattgtaagctcttctctttcccctcagataatgttccataagcattagtatgagataataatacactgaggaccaatatacatgaaaaatatcagactagaatcaaacaagacagaaaaaagatctgataacctaaagtgagatactgaacagtatgcagttttaaaaataaaaaatggtaataggatgttctaacaagagagttaagaaaccactgtgctactgagttaaatgttgatcagttggtctgtgacaattaaggaattcaagtattcagaaacacttcctgtgctggatgctctctgtttgttcttccaaataatccctcacttttccctgtcttgctctgtgcccaggaaggctgacatggacagattaaccaggctttccgccctctggcttggttcagccaatgggaagcaccagaggagaccatagggcacaaagaagcagccttgggagtattcagtaccccagtcccacgctatgatttggagggtctgcattcctctgcctctgggcacactctagtatagttacagctccctacacctgccacttgaggcccagaggaggtgatggctctctaactgttcctagttctgggtgcttcctgttccttgtggatttcccaactcctcacctttgtaaataccctcctttttcaaactctattcagttagcttttatcagcctgactcacagaagtttggggtttcaattcatattacctgaatgacccaggaaaacccatgttgagaaattaaaatgtttacggggtggtaataccacttaagagaaaaaatatcaattggatttttaaaattccacctatctattggtgtgacacatcaacaaaaacatatagaaagattggaagctaaaagatagataatatagtcatatactgttatagtattatatcaaaagatattaagtcagagcattattaagaatggaagaagggccaggtgtggtggctcatgcctgtaatcccagcactttgggaggccaaggcaggcggatcacttgaagccaggagttcaagaccagcctgcccaacatggcaaaaccctggctctaccaaaaatacaacaattagctgggcattgtggcacatgcctgtaatcccagctacttgggaggctgaagcacaagaatcacttgaaccggggaggcagaggttgcagtgagctgagatttcgccactacactacagcctgggtgacagagagagattctgtctcaaaaaaaaaaaaaaagaaagaatgaaaggagtcacctaaaaaagataacacaattttaaacataaatgtactacattattagtgaattcatgtttagaattgtgttaatatacaaagcaaaaattgtagaattataggagaaatggacaaatctacaatcatcatgggatgttttaacattcttctttccataattgatagatcaggcagaccaaaagaaagaaataagggaagatacggaaggtctgaacaatctaagaagcgcaatctcatagtcaatacataaagctcagcaattgtttaataatagtaagcagagaatatgcagttttctcaggtatagatggaacatgcactaactgagtaaatactaggcagaaaacagtctgaacaagtttcaataaatctgtattacacagatcattttctctagcctcaatataagattataaaccaataataaaaagatgactaaaaagattctaaatattaggaaatgtaaactactaataagtcattagaagatgtatagaatggaacaataataaaaagttatttataaaaatatacaatgaagctaaagcagaattttaaggaaaatttgtaggctttaaatgcttatcttagaaaaattaaaaagctgaacattaatgagccaagcatctaatttaaattttaaaaagaacatagaaagccaaatataattttttaaaaagaaaaaatagatattaaacaatataacagtgaagttaaagaaaacaagaatgcaataaagaggaaaaacaaacaaaaaaaaaggtagcttcttttaaaagaaatttaataaaatagacatacctccaatgagatttatcaaagtaagacagaaggcacaaatggaatgaatacagaaactttttaaatattacagaactttataataaatcttatgctactaataaaattgaaagtactgataaaattattacttcctagaaaaaatatttctgagtaaaactcactcaaaaaacaaataaagcatgggcagacctaacattaaagaaatgaaatcactactttaaattttaccgacagataataaaacgtgcatctttatcaagcaaaaatggaacttgtcagttttataggaaatttagaagtcaaggcatgagtaatgccaatctcataccaaatcctacaaagaatagaaaattatggctcccgcttatagacatagatatagaactcctgcacaaaataatataaataacaaaccaaattttatatttgcaactatacatattatatgtgtatgtattatatatgttaacatatacatatataatatgtatagcatatgttctacatattatatatgtatagtgtatgtattttacaatatataaatgaaaacccaatctttaatatattcatctagattgtcatatatgacatatataatacattacatcaaaaatgtgtacaataatcaggccaggcacagtgactcatgcctgtaatcccagcacgttgggaggctgaggcgggtcaatcacttgagtccaagagtttgagaccagcctggtcaatatggccaaattccatctctacaaaaaatatgaaaaattatccaggcattgtggtgcacaccaatagtcccagctactcgggaagctgaggtgagaggatcacttgagcctgggaggtggagattgcagtgagtcgagattgcgccagtgcactccagcctgggtggcaaagggagaccctgtctcaaaaaaaaattaaaaaattagccaggtatggtggcctgttcctgtagtcccagcaactggggaggctgaggtgagaagatcactttagctcaggtggtggagccatgatcgcaccactgtaccactcggcttgggcaacagagtgagagcctgtctcgaaaaaacaaatatatacacacagtaatcaatatatatattatatgtaccaatcaatgcttcacttttatatataatatagattacatcttattagatatatagtattccttctccatagatagatagatacagatatagacatagtatcctctatccatattagagagaggatactatatatatctatagcatatagagatgctgtctcaaaaaaatttaaacatcagccagatgtggtggcccatgcctgtagtcccagctactggggaggctgaaatgagaggattgccattgatcctctcattggttgagccataatcgcactactgcaccactcagcctgggagacagagggagacctgaggtggaaggatatagatatagatatataaataaatatgtatagagagaatataatatatgtgtgtatgtgtatatatatatattatgaagacactgggagagaatactatatatatatgtgtgtgtgtatatatatattatgaagacactggtgggatggtttcattaccaattggaccaagagtccaggtatggagccaacatgcaatgttgttgttgactgagctggcagagcactggtcatagttacgggaaaagaaggtctccaatgagacatacttaacaaaatatatgaacttgccatatacgtggagagttctggtgtgtatatagccttctctcaccaacctagcaattgtcttcatcatcattataatgctatcagagcaaagatgacagctaaatttttttgtccctttcttcttctttctcttccttcccctcccccacctctttctcttcctcctcctccttcatctctcttctttttttttttgagatggagtcttactctgtcgctcaagctggagtgcagtggcacaatctcagctcactgcaacctctgccttctgggttcaagcaattctgcctaagcctccagagtagctaggactgcaagtgcacaccaccacacctggctaatttttgtatttttagtagagatagggtttcacaatgctggccaggctggtctcaaactcctgccctcaagtgatcctcctgcctcggcctcccaatgtgctgggattacaggcgtaagccactgtacccggcctcctcctttaatagacagggtctagctctgttgcccaggctgggtacagtggcgtgatcatagcttactgcagcctcgaactcctgggctcaggagatcctcctgccctagtctccccagtagctggaactacaggcatagcacacggggctaataaaattaattaggtgataaaattcactgcccactgatgactaagctctttggacataaaagacacagaccttgaaggaaaatgtgtctacttaattttgaaaccctatttatcaaaaaacaggatgaaaatgcaaaatgccatccacatgccagaagatatcagctataataagttcccataaatcaataaggaaaagaacccaataaaaattattaaaccacagtaaatcatgggtaaatcacagaggcctgaagggctaatggacatacaaaaagaatctcaatctcactagtgaaatcagaaaagcacaaattaagtacacaattaggtaccattttaaatctgtaagactgtcaaaatcataaattatataagtaaagactcagggagttttggaggagtgagagctcttatattgcttgtggggtagaattggaacaatttcaagatctgtagtatctggtaaaattatgatatgcatccctcacaccagcatgtcactccaaggtatctccctggagggaacatttacgggacacaaggaagcatggataagaatgttcacagtagtattgtctgcaacagcaacaacaacaaaaaaacccaactacacacaacttcaatgcccagtccacaaggcaatggattaaataaacttcaggccggagatggtggttcatgcctgtaatcccaacactttagaaggccgaggcgagaggactgcttgagcccaggagttcaagaccagcctgaacaaaataaagagatagtgtttctacaaaaaatttttaaaaaattagccagacgtggcagtgcttgcctgtggtcccagctactggggaagctgacgtgggaggattgcttaagcccaggaatttaaggctgcagggagccatgatggggccattgcactccagcctgggtgacagagtgagaccctgtctaaaagagataagtaaataacaactttgcattttctgccacattgcaaaatggtgagagagtggtttctagactctagactctttctatgactaccttctagttatgagatcctacaacactcacctaacctctctgtgtcatatttcctcctctataaagcaaaaatgccccatatagagaggactgtgatataaaacaagaaccaagaaaagtaaagcttttctaatctgtcacagactaaagagtgctcagtatatgtgagtcattattcctggtgctggtaggagtgtatgttacaactttgagtcaagtaatatggtaccatatattaagattaacaacaacctcggcaatcccagtttggggtatgttcccaaaagaaatgaaagcaccaggatataaggatgcatggactagaaagttattgtagcaacattgtaataactaagttctaaaaacagcctgaagctccatcagtagggatatggttacatatatttattatattcttatggaatattagacataaaaagtaacgagtaacatagaagagacagtgtatatatgttacgtttgtacaaacttagggaaagatatagatcaccctacctagagaagtcagattggagacgggtgggaaaaaccttgaactttctccttatatcctttatattgtttgactgattaaaatgtatttgttgcatctgcttgaaggcaatgtaaaataaaataaacatacatttaaaaataaaaataaaatttattcctatcacttttgtaataaagctgggcacagtgactaacacttgtaatcctagcactttgggaggcagagacaggcagatcacctgaggtcaggggtttgagaccagcctggccaacattgtgaaaccccatctctactaaaaatacaaaaatcagccaggcatagtggtgcgtacctgtaatcccacgctacccgggaggctgaggcgctggaacccaggaggcagaggctgcagtgagctgagattgcggcactgcaagccagcctgggtaacagcgagactccatctcaaaaaaaaatttgaaaaaagaaaaattttaataaacagtgtttaagaggggagaaatatttagttaaaagataagcccatttaagaaatagtttcacttgacccggaaggcggagcttgcagtgagccgagatcgcaccactgcactccagcctgggcgacagagcgagactctgtctcaaaaaaaaaaaaaaagaaagaaagaaagaaagaaatagtttcacttgaaccatattatgattccttctgtaaaagatgagagtaggcaaattgactcagtgaaatcccagcaaaacttacacaaagtcttgttcttccttcctgtcatctgtataggatgaaatacagagtgcttttgggttttgttgttgtttgttgttgtgtatttgaggggaacacaggtctataattccttttctgaaatccctggaacaaaatgggctttgccattcaaattagtttagaagttataaaggcaaaaaaatgcatatactctaaagttcaaccccatcatggcctaaggcagagccctgtaatcaaattcatcaatatatctgcagcaaaacatttattcaaattaagtgggataaataaagacttttaaatagtctcatctcagtgccgttcagggttggccactgtggaagacagactcaagggtggccttctatgattcctgcctcttggtgttcacaccctcgtaaaattccttgtctttgagtgtgagcagggcttatgaattgcttctgaccaataggatatggcaaagatgatgggatataatttctatgattacgtttcattatgtaagactccatcttgctggcagattttctctaaagagtctgtctcctgagctctctctgaagaaataactggccatgttagaagcccatgtgcaaagagctgaggggtggcctgtagaagctgtgggcaacctccagccaacagccagaaataaccagggccaaagtcctgcaaccatcaggaaagaaattctgcctgctacctcagtgagcttggaagtggattcttccttagcctagcctccagataagaacacagcctgaccaacaccttaactgcagccttatcagaccctaagcagcaggcccaactaagctgtgcccagattcctgaaccacaaaaattgagataacatatcagtgttgtattaaggttctaaattatggtaatttgtttgtactaatagataactaatataaccaccaaatcatttcaggttaggccagatttttgtagccaaatgaatcatgataaaactttccattttcaggggtttttttgattttgtacttacggatacaaatttgtgaaagtatagtcagcactgatttaaaaaatcaagggagcaggaaactcagtaaatggttctaacattttggaatctgtaaattggttgtaacatttgtcatctgtgttatctaagtcaagttcctaaaatatgtgaatgataggttatcatactcacctacttttcttgcattgctctaagagttggctgagctattgataataaacactatgatcagatctaataccatgatgtgctattatgatcatgtgtcagtcacagggctaagcactttgtacatgttgatgcatttaattttgatgataactcaatgaagtaggagctgttaatattttcatttttcagagggggaaaccaagtcacttggagtaacatggctaataagtgaaagaataagaatttgaaaggtttgcacagataaccagaatgcaatgctcatcacattcactgagcagtgaatcatactaactagagaaagtatgaaagctctactgaaattaactaaacaacctctctggctgtgagcctgccaagggacaggtggtaaacttggttactgcataaggccccttctatccacagtattcaggaattctttagtgaacataccttgatgactccttaacattttcttcacatcgaagtaaagcttggaaacattgcacatagtatgaagttccaaggagacagcctctgatgtttccagcttcacagcccaactcctagaataagcagaggcgagagatttcttcagaggtgcattccattcatttctatatacgcacacccctcccctcctgcattcaaacaggacttacctgctcaaagtgtcattcacattctataaagaaacaaaaagaaaaggtgagcatgggaacatcggtatttcatggggcttgtcatgcagggctattcttctttgctttacccgaagaagtaaagagagttaccctagtcttagtcttagatattgatggatactcaaacaaagtaattcccaccagtcttaggtattgatggatacccagatggaataattcctaccagcttctgggagattcagcatggcaggatgtttatcaacatttgcatctattctcatccttgctgaagtctgagggccaggagctttgtccatgctccctctgtaaggactagcttttggtgatcggatttccttcacagtgagcccagattagagaacacttatcataaaggtccttagtggtgaatctgtgcacagccctgagactgggccactgccactaagatggtggtagcaggtatcacacagtggtaaagcaatcatgctatacactcagccttacagtatagtcaccaatcctgttagttagaaccagaattaatggctccagatgtttatcttcctacagataaagctgtagattgtaccataacagctctggagcaagggttctacaagcaaatcagggaaaaggttatcactcattttggctgccccacttcatcacccatcagtcacctagtggagtatttcaggagagagtcaacaaccagggttctctgcacatgggccaaggaggcaaacagtggtaaatgttatcccgtggtttcatttggccaagctgtgttccctcagaagtttatttttctaattgacataaaggtaccctataaattagtgaaggccagcctgatggcactgatgtacatctaaaagaaacattactttatcttcccatgcttccttaccattctcctttaatagcactataacataccttttttccctactccaagtacacagcctcacctgcagcaatttctgggctgagccctgacatttttcctccagttccaggatgtggctcttgagttcattgctcttcagccccagaccagcctcatagtccctcagtctactcagagtctgttgttcttctttctccagcctccagagataagacttctcttcctcatgtaggaaacactggagattcttaaagtcagaccggattttttgtctctgaatctgtaccttctcctggagtcaagaaagtatggtcaaaaggtggaagtaaaccaaatgtccatctatggatgaatggataaacaagaatgaaagtctgacacacgctactacatgacaagccttgaagacattcaagcaaaataagccagaaacaaaagggcaaatattgtaagactttgcttatacaaggcatctggagtagttaagttcatagagacagaaagtaaaatagtggttacaaggtgttggcaagaccagaaaatggacagttattgtttaatgggtagtgagtttcagtttagaagatgaaagatgaaactgagttgcagtttggagatgggaatggtgatggttgcacaacaatgtaacaatgtaaaagcacttaattctactgaactatatacttaaaagtggttaaatgcttaagtgttatatatattttcacacaaacacacacacacacacaatcagccactgggacattattttctcatgagtcactgaagctggaagaatgtccccagtttcctgctgcagagtcatgtgtgggaggcaggcactcagatgtggaagaggttgcctcagattccttatagtcacccaattaattttcttgttcttcagccaagacacaggagaaagctgggttaggagtgctagataatttaattgtgaaactagggccaagttcaaacactttatcagttacaaggataaaaagaggtttttacttatgatttaagaagttagatttctgagttggagcgattttcttgaagtaaaagcttataatgaacatcacccagactggattttaagacaaccaggctggtaagagggtccataattcttggcagggggagctttgagtgtgacaggcatttattatggttaactgagaaatactgttctactaccctagggtcatcttaagcattcctatgtgtaagactgacagaaatcaagtgaaactctcatctgaggagatgtaaagttgcaatttccattagtgctgtctaaattaatgcagtgggagtgtgtattcagggcaatttgaatctatgttcttggattgcagtcttcaaacttggcccaaataaactctctacttatcttaaaaaaataaaaattaaaaaataaaaataaattcatacagtgttttgatgactatgatatagaagaagggtctttgacttaggatgaggtggaatttttgtgtaggagacaggtgcagctttaactcttgtatagacgggttttcatatatgttagttacaatcaaggtcttccccattgcccaagatcctagaaatgggggaagtaagagtgtactcaggagctcaagagcaacatccacaaacaaagatcagggtagaggttagagaggactcctgaaagagagaaaattggtaatcagcttgtgggattttactgcaagctagtgaattatataaatataaagattggtgcaaaagtaattgtggtttttgcctttactttaatggcaaagaccgcaattacttttgcacaaacctaaatatttccataaaagaatgtggctctgataatgtggaggttagtcagccacggaaataatctgaaagtttgtagttgcaagtgtgtaggttgttgcattacttgtgatgtacttataaatcaagtataggccgggtgcagtggctcacgcctgtaatcccagcactttgggaggctgaggtgggtgaatcacgaggtcaggagatcaagaccatcctggccaacatggtgaaaccccgtctctactaaaatacaaaaaattagccaggcatggtagcacatgcctgtaatcccagctactcaagaggctgaggcaggggaattgcttgaacccgggaggtggacattgcagtgagctgagatcgcaccactacactccagcaagactccatctcaaaaaatagtaataatttaaaaataaataaataaataaagtatatttctttcatcagcttcatgagctagagtagtatgaatttcaatctggagtgatcctgttttctaagtgttcacaaagcttggtttctgtacctgtaaagttgagagccagatgctccactgtggtaaaagtgccagggtaatgagttgaggcctgcaaaccaggtttattttgacgtatttaaagtttgagacccactcgatgctttttctaggtaaatagtcatactaattctgcttcttctgactgaagtatcaggaatcccagccaactacagtttaaagatggaaagattggtgctaaatactcatggatgtaaacctggaaccaggggcataagtacaaataatggtttcttccttgggtttcattttttcaatctggtttagtgagaataaatcctcattgtgcttttcctcaatcatcccctatgcctaagctctagaatggaaaatagcttgagatcaatgaagtcagattcttactttccatttagttattcgcattgctgtggacagcttctgctccgtacatctgtcttcaagttgcttcagttttgtcacagctttctggagcttttcctgaaggaaaaatttgataagtgaagcctattcaatttgactcttcattagggacctagggggaatcccaatcttctaagatatatttgaataatagtgaatatttatagagtcctcattgttttttgctagagagcatgctaaaggctatatgtgcaggaacatactgatccccttggcaaccctgaatagttggtaggattttaaacttcatttctgtgctgtagaaaatgagactaagaaaggggtaaaataacttgcccaaagggctatgactgccaggtggtggagcaacaattgcaatctcatctgctgacccagagcctgagctatgtccaccactagagtcctgccaggaaaaagttggatatagaacaaggtaatcatcatctaaaagattttgtaaaacaacatgctgaaccaagcaaaaccaataccagtgtttggcacacatgaaattttgtgtcttatgagtcaggaaaaatcaggatgccagctggttattagaaacagttcatggaagaggggaattctggtatcttttgaacaatggtatcatgaatccaatttaaaatgatttagtattcatgtcaagcttttagcttattcttcaaaacagtttctcatatttctattgaaagtgatttgaagctgacccaaattgctaattgtagtcaatgctgaaagaattgtctcctgtcctctgtaaacccaacaagtatactcattcattctcgagtgttctcaggaaaaggttctatgtaactgttttagcaaaagatgacattgtccttactatatgccaagtgctattctatgcattctatattttaatgtcctcaaagcttataaccacctcctgtgtatgtgttttagggagggaggacactgctattatccccatttacagatggagaaaccaaggtgtgaagacattaagtaacgtgcccaaaattgcccatctagtaagtgacaaaactcaatttcaacataagctggttccttttcttactacttggtggaaaagtaattcaaatgggaatatgatcatcgcagttattagctgctccatggagtttaaggaagagctgccatgagctgagtggtggtcatgattgacatgtccttagaaggacttagagccttcatacaagaccacctctgcctcatggaggacagaataaggagcctgacactggagacaacattttcctcaaatttaggcaggacagagaaggaaaaaggacatcaggactatgcccattcctccatgctgccaacagcaaagtcccaccttccttaatatgctttctggcaagaaatctggatggtacacaaaacctctccctctgcttcaccttccacaaccaagcatttccaaatctttgactcttcttcctgaatcgtgcttaaaatctgccctctcctccctttcttatacggatagtttgaattttactccttgatattccttttatcatagacatgccacagtagctgggcacagtggttcatgcctctaatcccagcattttgggaggctgagatgggagggagaccaggggtttgaggccagtataagcaagaaaggcagaccatgtctctacaaaaaataaaaaaattatccaggtatggtggggcatccctgtagtcctagctacttgggaggctgaggtgggaggattgcttgagccccagaaggttgaggctgcagtgagccgagattgcaccattgtactccaacctgggatacagagcaagaccctacctcaggaaaaaaaaaaaaaaaaaaaaaaaaaagtagaggtaccagagtgatattttcaatgtcactgacccttcattccccaaatgaaaatcccccaataggtgttcaatttttacgtgtccttcaggagttacttctaagatgaaccactctctaccctaaatgtccctccccaccaccaaaaccagggacctccaggcagacatttttgatggtttgttttctttactagactgtagatacctaaaaggtgatgggtctttcttccctgttttcaggccctactgcatggctttacatattgtggtttttcaaatgatattcatggtgtgaaacaagaaaaaatgcgggtgtttggtttgagaacaacctgttctaaagcaaaaagaaattcatcataacacaaatggatagagataagagtccaaccatcccattgaaggtcaggatggacagtctagataattgagcaagaaatcatcataaactatttttcagaagaatgacatgatgaaagctgtatttccaagtcataatgttaggtttcaagttaaatcatctcagctcctggggagcaggataagacttggtacttaccaaagctcccgggcccacacactcaccttgtagccctggcatacgtcttcaacaagagctgtggtgtgccctttgtgctgtggtgcccgctcacagcgccagcagatgagctgcccctcgtcttcgcagaacaggtggaactgctctccgtgttcctcacatgacatttcttgatccgtctctttgagggcttcaatgaggcttcccagctgcttgttgggtcggaggctatccatatgaaatggagcccgacactggggacagcagaatgtctcctgcctcagttgcttttggcttgggtttttaaagaagtctgttatacacaagtggcagtagctgtgtccacagttgatgcttactgggttcgtcatcaggctcaggcagatggagcaggtggcttcctccatcatcttcttggtgctggtggttgaggccatagcttttattgaaaagctccaatattggctctagagatggagatgaagcagccagaattttccaccgtgatgaaaatacacctcacctgcacctctatgtgatgagctggctgcaactgacttccataggtcttgaaggttttccttccaacccctattatctcattttgtattgaagaaaagaggacctaaaaggaagaagttgaggctgaggttgtttgggccacgtttgagaactgcaacccaagtgcagagtttcaagttgccctcattagcaagcagttacaagtggttgtttagaggaaaaaaagcagttttaaagcagttttaaagttgtttgccaagaatttacattaaaatagcataagcttttgactggctatacattgttctttgtattacaaatctcgggaatatgtaggtaatagatgaggcagccagtcaggaacaaaatgcttttaaacatggggtcttaactgaagacctatactcctgcctcacttgtcctgataaattttgcatacctcacatagctcagactgctctaaattatttcattatttttcttttctcagtcttctaacttttttttttttttttaatgagacggagtctcactctgtcacccaggctggagtgcagtgacgctatctcggctcactgcacctccgcctcccgggttcaagcgattctcctgcctcagcctcccgagtagtagctgggtctacaggtgtgcaccactacgcccagctaatttttgtatttttagtagagatggggtttcaccatgttggttggctcgatctcttgaccttgtgatccacccgcctcagcctcccaaagtgccaggattacaggcatgagccaccgtgcccagcctctttttcttttcttataagacaagttctcgctctcttgcccaggctgtagtggagggcagtggcatgaccacagctcactgcagcctcgacctcctgggtttaagcaatcctcctgcctcaccctggcagagtggctgggactacaggtatgtgccaccatgtccagctaaagtcttctctccagaaagaagaaatgcattggaatttagaggatacacaaacatctagctgtatagctaatacagtagccactatcatgagtaggaatttaaatttaacttaataaaaattaaaatgaaaaaattcagtttttctgttccagttgccacattttgattgcttaatagttgcatgtgactagtggctacataacagcctcaatatacaacattctgttatcacagaaagttaccttggaccaagtgctgggagaagcaatgcaggcttcctcacaaaagctgtaaaagagagaactcagggagtgtgaaactctttcctattctagttaacttcaagaataattgttaccaggccagcacggtggctcacgcctgtaatcctagcactttgggaagccgaggcgggcagatcacctgaggtcaggagtttgagaccagcctgaccaacatggcaaaacctcatctctactaaaaatacaaaaagttagctagatgtggtggtgcacacctgtaatcccagctgctcaggaggctgaggaaggagaatgacttgagctccggagggggaggttgcagtgagcccagattacaccactgcactccagcctgggtgaaagagcgagaatctgtcttaaaaaaaaaaaaaagaataattggtaccagaattactctttgtaattagtagtaacacttatgcaattgggtgatctgtgacagattccattgaaggagtatggggagcttcaccccaatatatgactccctggtataatgagtattttgaattaaaggcccttagagatcagcagatgctggaagagacttttcccctatctacataaagaccagtcacactagacaagaagaacaattgtttttccttccaacccctattatctcattttgtactgaagaaaagaggactaagaatgtaaccagacctaatcagacactttcacaaaataatgtctgtctctcaggctcattcattttccaaagagaaccatttacaagttaaactctgttcctccattcattcatcctcccaaatattcatttattctccctagtaatcatttactgcccctcaaagaattacctatattctcctgatatcacccttcccctctgaaataaatatgtatacatgtataaacgttatacatacatatttatacagtatacatacatatttatacatacatacatatgcatacatatttatatttatgtatttatacataagtatttataaataaggctatataagtatctacccccattggcagagggggtaatcactctgtgattctagcccatgtacttgttaataaatttgtatgccttttctccaattagcctgccttttgtgagtcgatttttcagtgaacttcagaaggcaaaggggaagtgttcccttggctcctacaccatcatgacaataaaatttgactccacctcgaccccccccatcccccacaaagaacaacaaccaacactggttaataaggtcggttgttttttgtttgtgtttttgttgttgttgtttttgctttcaggagcagaggtataataggcaaaagaaagagaaaggagaatagtgaatacctcttctgcagagaggggtgcctaagtgggacttccctggctaataacgtcttgctagagacccaaccaggaggataatggaagcaatcaaggcaaccagaacaaccagaagaaccggtttatcctttttgtgccctctccctaaactgagggaataagaattggaaagaaggctgcagagcagagggtttgctcctgaggagcagttatttctatgggatcagagctcctgcagaactggggagtttacttttactatctcttctccaggacaggacctatctcaagagacatgttcagagtgattgcaacataaagagtttgcagacccaaggaggtagggaaggcagaaagaagatgggggaggccagggataggcaacagaggagtgaccaggagcgaaaaagcctgcctcttctgagaacctagctgggctctccctgtacccccgatccctcccccccgcccgcccccacacccctactcctgggagctcctctaggacaggggcagagtcaggaggaagtttgaagagtgcctagaataaaaaacagtaatttaactacaattaccgggtaggctgttttcctctcacaatttgatcagtctcttgaagccacacagaatttcttctgaagacgtgtattccttggcaggctatttcctccagtgatacaccaggcccctctctgctggggtcactgctcttctggggagatggggctcccctccttccaaggctccagggttcctgtcctgggccccactcatctaagttctgaatcttctgagatttggtgtaaagtctggtgaaagaaagagcaggaaagaggtgagagctgtaaaacaaagaaagtcctgaccattttcagagttggaggggccctgctgtcacgaaatatattccccaccccacttgccatcagtacacactcacatatccactgagaaaaccttagcctggaccttttccgtaaccttcactgctcagacacttacatattcgctgctagtcccctctgttgctgccacttcctgggtcaggaagttaactcagaccggattaaactgagaagtgaaactactgtgggaggcggggctcataagatttaggagaaaactagtgacgttgttcatatcatttgcactccgcctctccggtaaaggagggggaaacgtaggaagaaaatatccttcttttacagcaataaaaagaaggaaccaattaataaccctgtaaactatcatgtgaccccaacacagagtatctaaaaacaggaagcctgcagaggttcagttcacagactctgatttgagatctttctacttttgccaccaactcccttgggagtccttaagccttcctagctgatgttacttcttttgctatttatgggttgcttgtggttctataactgctctgaagggtgtggtggaaaaaggggtggtaacagcagtaggactcattggcatcacaaaattcatctgagtcagctttctattcttctctgtcccgttctgtgtcttgtttttctccttgctgtccttctgcaggactcagatcttcttcaatagcgagggtcagccaggatagaaaatgggagtcactagtggcccagcagtgagtgcccccagcttagagctgtgtgggatccctgggaccatcactctgctttgtgctttgtggagaaaaggctgtggggtccagggtcaagtccttaatgacttagctccagcttctccacttcaaaatgaaaggaaaagtactatcaccacccgttagaattattatttcatggggaaaaaagatggattactatctcacaataagagcttgtcacatttataagtctcaggtgtaagaggcatttatgataacaacataataaatgctggcttaagtagatgcagtggtccaagggaaccagtaaggggagctcaggacacaggtgggaggagaaattaaacttgaattctgggagccactggcctgtctgggcccctggcctgcctgctgaccctgatagccaatggaacatggagtttggcccagctgcaatccctctggtccaactactcaaaataaaggcaagattgggaaacacgttcctttcttcctataccaagcagaagactcttcagcactgcaccctcctgggtgctcacagagccttctgttgttttgccacctacgattcatcatgccctggcatgatggttgcagaccccatgcatagcatgggacattctactcctgaggcaaccagcacacagagagaggagaaagaatgagcccctgaatccttggtcccacgatgagtccttgcagatatctacaactttcattgttgtggatgtgactctgtacccaggcatggctcattccagatctgtcctattgtcagaggtgttcaaaccagaatgactccattttgaatgggggctaggtaaaataaggctgagacctactgggctgcattcccaggaagttaggcattgtaagtcacaggatgaaataggcagttggcacaagacacaggtcataaagatcttgctgataaaacaggttgcagtaaagaagctgaccaaaacccaccaaaatcaagatggcaacaagagtggcctctagtcattctcattgctcattatacacgaattataatgtgttagcaagttagaaggcattcccaccagctccatagtggtttataaataccatggcgatgtcaggaagctaccctatatagtctaaaaaggggaggaacgcttggttctgggaattgcccacatctttcccagaaaacatatgaataatccactccttgtttagtacataatcaagaaataactgtaagtatctgtattagtccattttcacactgctgatccagacatacctgagactgagtaatttataccaggaaaaaatgtttcatgctcttacagtcccacgtgtctggggagacctcacaaccacagcagaaggcaaggaggagcaagtcaggtcttacatggatggcagcaggcaaagagcttgtgcagggaaattcctttctataaaaccatcaggtctcatgaaacttattgactatcatgagaacagcagtataaattactcagggaaagacctgcccccatgattcaattacctcccaccaggtccctcccacaatatgtgggaatttaagatgagagttaggtggggacacagccaaaccatatcagtatccttagtccagaagctgatgctctgcctgtagagtagccgttcttttattcctttactttcttgctttcactttactgtgtagacttgccccaaattctttctcacacgagatctaagaaccttctcttagggtctgggttgggaccccctttctggtaacactatcaaaggatcaggaaaaggaagctagtgaatgctaaaaaggaaacaaactaccattaccaataataacagcaagacaaaagcaaaacggattgtgacagctgtcccatctcacacctgtttcccattgcaggaaggaggggctggttcatgcacagagtggccaatattagaagcagagatggggtgcagatgagacttcaggaatatgttgacaaaggcaggcctagggagaaatcaacctgaactatccccaaggaggaatgcattatctctaatatgtaaagttaggcttgatcctgtgattatgggatataggagtccaaagactcacaatgggaagtaggtcactagagtctccttcagaagctctgtactgtgtgttcccactgtgggcaagagtcagcactcagctattcctagaatgcctttcctcaactccttcagattttgcctctcaactaaccctatcctgaccacttgttagcaagtgtacccctctctccctcccaaacattttcaaatctattttgttcccatggcacttatcactgaatattttactaatttattttgtttagtgtttgcttccctcatgagaatgcaaagggatggatttttttcaatattgttcactgatgaatcccagtaactagaatatttctaagcatagtgatgtgcattaaatcaaagagtaactttctgaattgcactaaacacacatcacaagaggtgtgtgcacatatgtgcatgatgcacgtagtgtggtgtgggtgttgtgtggggtatgtggtactgtgtgtgctgtgtgtggtatgtgatacatagtttgtgttagtgtgatgcatgtgatgtggtatgtgtgtgcgtgtccatacatattaggggtggcggggatgttaatatgtcaaatggtactagaaagtatcagaactcatggtgcttactggtttcccagagagctgcttctctcccacctgtaggatatactgatggtttggacagagaagaaataaaaagaaggctgtgacctactgggctgaggaaataaaaacgaaagtaaaagaagagctgggaaaagagagtggaggggccaagggaaatttcccctttggcttctggggaaactttgctgaaaaatcaactcacaaatttattaacatgtacacagggagaaccatagaatgattatccacttcccaagagggcttaaaagcttatatattatcctggcaaaacagattatgggaggggaagaagagaaactctgttgatgggattactgttgcggatttttgctccttcgctcagctaggtccgggtttttgtctcacagccaggaagaattaggcatgcagccatcaaagaatgagtggagtagaatttattaagtgaaaggaaagctctcagcaaagacaagggtcctgaaagcagatttctggtttgctcttcacagttgaatactagggcttaagactcaaattcctgacaactccaccctgtcctaccagtgcatgcaggcctttagactgagctactccatattgattaatttcctgaactgtgcatgtgttaaggaaaggaatcatccactgcaggcatgtttaggcaagccccctgtgcaagttcccttatctgcacaaaacatccggtgtaagcacttgtggggcaggtcagaggttctctgggtaccattcccttactgtctgcctaaagcaagctggccaactcctttcattactagggagagtaagtagatcagggaacagagattaacttgaacattatcttgtgaaagtccgttcgggcatggttacattcttggtcttacaggaagggtaaataaaaataattgctctttttggtgggtctggatcttaggtagataaagaaactttaattccacgatgtgttttggtagggatagttggtggcagggatgtcagagagactttgaggcttcttcagttcaatatgaccaagggccatatattagggtatcaatttctgagccccaacaagagcttaggagagatgtgatagcatcacagtgtgaaagcaattttttgtttgtttttagagacaggctcttgcactgtcaccctggctgaagtacaatggtacgatcacagctcactgtaatcttgaactgggttcaaatgatcctcccatctaagcatttcaaagtgttgggattacaggcatgagccacggtacccagcctgaaactgcacccactttctgataaacttttcaaatgactaaaggggagagagtaagcactactcagaggtaggaagaaaggacacaggattataggattaaaacaacaaccaccaaaaaaaaccagaccggtgtggtggctcacacctgtaatcacagcacttggggaggctgaggtggggggagtcactggaggccaggagttcgagacgagcctggccaacatagcaagatgctgtctctattaaaaaaaaaaaatacctgccttgagctaatcagaatcatggaccctgacaaaggatgtcccaaagtaagtcttagcattttttttttttttttgagacagtctcgctgtgttgcccaggctgaagttcagtggcgtgatctcggctcactgcaacagctgcctcccaggctcaagcaattctccctgccttcagcctcccaagtagctgggattacagatgcccaccaccacgcctggctaatttttgttttttttaatagagatggggttttgccatgttaaccaggcaggtcttgaactcctgacctcaagtgatctgcccaccttggcccctccatagtgctgggattacaggcgtgagtcactgcacccggcaaagtcttagcattctttacaaacagtttgtacccgtatctctaaaagggagtagtgaatttcaccccaaaatgtggcttcctgatataatgagtattttgaatgaaaaactcttagagatcaacagacactaaagagacttttccctaggtacataaaaataggatggccccaccagcgagaacaattgttcttttctccctctctgttatctcattgtgcattataggaaagaccaagaatgtaaccacacctgaacagacccttttataagataatcagtctctaagcatcatttaaattccaaggagaactatttacaaatttatctgttctttgatccaattagtctctcctggtagttacatattgcccctcaacagaattcctcttcttctgtttcccataacctattttgcaaggatcaagcccctgttatttcttcaacttcaaggtggcatataagcttctaaattccactgggatattggtactatgtgcatgaggagaaccacagagtaattaaattgtaaagccttttatcttatgaatctgcctttttttgtgttcatttttcagcaaaacttccaagggcaaaggtataaaacaaaaataaaattctaaagccccccaaccatctgaatagactttctcttcagtcaggcttcttaaaatgtaacctgaaagactggctcaggccattaagggaagtgggggttgaacatgcctcattattcctctctggcattaacatcaacacagcttttaagtctgataagaaacattttacaacctattctctctgaagcctgctagctaaaaacttcatcccatagtacaactttggtcttcacaacctgttatcacaacctagtgctcctttctattaatcccaaatctttatacaaactcaaccaattgtcatcacctccaccccactcctccgctgcttccagttgtcccgcctctctggaccaaaccagtgtacatttcttaaacgtatttgattgatgtcccatgcctccctaaaatgtataaagccaaggtgcatcccaaccaccttgagcgcttgttctcaggacctcctgagggctgtgtcatgggccatggtcactcaaatttggctcagaataaatctcttcaaatgttttacagagtttggctcttgtcatgacacagatgactgcttcactgaagcctgctctggaagtgagtgggggttttgcaaggataattttccccggatagccccagaagcagctagtaataatacacttaaaggtagctaaaatgcattgaacacttgttttgtgccagacctatgtcaacatttgctttgtgccaggcttatgccagtactcctgatttgttaatacattctaaataaaaattctggagtttcaaatataataactgaaaaacagaaaataaataaaaatatataataactgaaataaaaatttactaaggctggggatggtggctcactcacacctgtaatcctgttaccggaaaggggtccgtccagatccagaccccaagagagggttcttggatctcacacaagaaagaattcgggcgagtctgtaaagtgaaagcaagtttattaagaaagtagaggaataaaagaacggctactccataggcagagcagctctgagggctgctggtcgctcatttttatggttatttcttgattatgtgctaaacaaggggtggataattcatgcctccattttttagaccatataaagtaacttcctgacgttgccatggcattcgtaaactgtcgtggcgctggtatgagcatagcagtgaggacgaccagaggtcactctcatcgccatcttggatttggtggggagcagtgaggatgaccagaggtcactctcatcgccatcttggatttggtggggtttagccagcttctttacttttttcttttttttttttgcccaggctggagtgcagtggcacgatctcagctcactgaaacctccaatttctgagttcaagcgattctcgtgcctcagcctcccaagtagctgggattacaggcatgtgccaccacacccagctaattttttatatttttaatagagaccgggtttcgccatgttgcctacgctgatctccaactcctgcgctcaagccatccagccaccttagcctcccaaagtgctgggcttataggtgtgagccaccccacctggcctagccggcttctttactgcaacctgttttatcagcaaggtctttatgacctgtattttgtgcccactgcctgcctcatcctgtggcttacaatgcctaacttacagggaatgcagcccagcaggactcagccttatttcacccagctcctattcaagatggagtctttcttgttcaaatacctctgacaagcccaacactttgggaggatgacacaggaggattgctttagcctaggagctcaagaccagcctgggcaacacagtgagaccccatctctaaaaaaaaaaatacaaaaaaattagccaggcatgatggtgtgtgcctgtagtccctgctactcaggaggctgaagtgggaagatggcttcagcccaggaattcaaggctgcattgtcagaggcatttgaaccagaatgactctatcttgaataggcgctggataaaataaggctgacacctgctaggctgcatttccagtatgttaggcattcttagtcacaggatgagataggaagtcagcacaaggtacacatcacaaagaccttgctgataaaataggttgtggtaaagaagttggccaaaacccatcaaaaccaacatggccaccaaagggacctctggttgtcttcactgctcattatatgttaattataatgtattaacatgctaaaagacactcctaccagcatcatgacagcttacaaatactgcggcaatatctggactttaccttatatggtctaaaaggtggaggaaccctcaattttgggaattgtccaccccttttttggaatgctcatgaataatccaccccttgtttagcacataatccagaaataactataagtatgcttatttgagcagaccacgctgctgttctgcctacagagtagccattcttttatttccttactttcttaataaacctgctttcactttactgtatggacttgccctaaattctttcttgtgtgagatccaagaaccctctcttggggtctggatcaagacccctttctggtaacatctttctggtgaccacgaagggacaatactgaggagactctgaagccaaaggaaacagactacagcaccaactggctgactttgggtaagtggtggagtccccgggtaaaggataggattgggttagaggtgcaacttaggggagatagggtctctcctaagacagagagggtttcagtccgctcttaataaagggcaagaatgcttgaccgaacttgggtttgagacccaacttaggaaggctacagtccttaagatttaaggggttagaggcccctctcagtaaagtctctcttggttaaaaacggatttagcattaggggatgttaactgctattctgtttgtattaatcttccctgtgctctttgctgacagctatgggtgacaggattaggcatgtacaggatcacgggacattgggaacttttcttctctccaaaaggggaagcttgacagctgataggactgttggaaaagatccctttgctatgacaagcagccgcctgaacttttgattcagtgttgctgcaatgggtgggtctttctctggcctctgtgaactcctcaccttccccatctcaccacaggcaatgcttttctccctttctctcttttctcttttctgtcttttctgttacttgagacaaccatcttgcccagagaccatatgttgaaactcctggtcagaagtttgattaaagatgaaagggcctatctgggggcaagtttgagccttcccagttagatattgggtgctaagtggagtggccaatgtctatgttttgtcacatgtatattgctctggctgaaatggaaaacgttaatttggttactttatgtggccattgggcagcatcttacaaaagtgagagacatttatttgcctgtggttccatgaaacagaaaaaagttggttttcttttgtgtcgtagcttggacccaagggctttgcagtgagcaaggttgctagtgctgctcagtgaaagagaacccagaaacctggcatgccagcaaaagggtaaagatttcttaccagtcaggcttctggcctctctctcttagtgaaaactgaatgaatggtaaaaatcactgtttatcacctctgtaaagttttgattaatgggaacaaggatttgtggggctagtcttaagctgtaatgaatctggtatactttgtgatatcaatttgtctttctgtattactctgtcataaagaggaatatggtaggatagaacatgggctcaggactccataagcctgctgttcaagccagcccagtaaactggtccgttgcaaagtttattacaggtccctggaaaaaaaaaaaaataaaaactggatgaagtttccttctcatcttgttttatgtcctttggagcttcaccttgtaaccacgtggcggtactttctcttggtctctgccatccagggaacaggaattttggggtttatgtaatagttaactctaaaaattatctcaagccattgcaagctcaaaattggctgctctggaccccttctgggaagggcaatggaaactaaccagtgttgtagctcagcagctaaggatttgtcattttataatggcggccaaggttcaatcctggcttagggaatgagtactttctgattgatatctgtgtgacctttaccatttgttgattctgttctcttcccctccacacactgtcttgagttttcctctctctgagaacctgggagattatctttggtaaagttcaaaagccagaaataatggccgtgtgggatggctaaagttgagtaataagaaacttaaaaggactccttttttttttgctttagagtgctatggtttatggttaaaagcttaattaaaagtggatattcaatctctaaaagcctgggactccttgggaaaagcagaggaggcaccacagaccccattttgggaaaacctctgttttcctcatgaaaccccaggaactggaagtggatagatccttcgcaaaatctaaggctctgtttggctttgcattatgttatctgatgtttttgacttttgggggtatcagaaattactttgcattatgagggagatctggtgtgtaataaccaggtaggaaatatacttctggggatagctaaaggcaaatataggtgaatacttggctatttgcacttttggatcacaagaagcattctcttgactacctagaaggtatggaaatgtctccatccccaccgagagataagattcccaggggagatggctgatcccccaaaagagggctgattccctcttttgggatccaggatctggtataaaaatgggaccctggccaggcacagtggctcacgcctgtaatctcaacactttgggaagcctcagagttatgaatgtctcaccatactgacactttgtgactgagctcctctctaccctggacacaagagaccctaataattagacaggaatatcattgcccctatttagtctgaagaagttatagaagacggatctttatcccactgcaatccttaggattaagggttccctggtaaaagggagtgggaaaatatgtcagaggcatttgaatcagagtgactccatcttgaataggggctgggtaaaataaggctgaggcctgctgggttaggttaggcattctaaccaggagtttagtcacaggatgagatagaaggttgcacaaggtacccgtcacaaagaccttgctgataaaataggtaacggtaaagaagccagctaaagcccaccaaaaccaacatggccacaaaagtgacctcttgtcatcctcactgctcatatacactaattatactgcattagcatgctacaagacactcccaccagtgccacgacagtttacaaataccatgacaacatctggacgttaccttatatggtctaaaacggggaagaacccttagttctgggaattgtccacctctttcctgaaaaattcttgaataatccattagtttagcacataatccagaaataactatacgtctgcttatttgagcagtccatactgctgctctgcctatggagtagccattcttttcttttatttttattttttagataaagactcgctctgtcactcaggctggagtctggagtgcagtgacgtgttttggctcactgcaaccttcacctcccgggttcaagcaattctcctgcctcagcctcccaactagctgggaccacaggtgggtgccaccatgcctggctaatttttgtattattagtagagatggggtttcgccatgttggccaggctggtctcgaactcctggcctcaagcgatccacttgccttggcctcccaaagtgctaggattacaggcattacccactatgcatgacccattcttttatttcttaacttttttttgtttttttgagacagagtctcactctgtcacccaggctagaggctggagtgcagtggtgcgatcttggttcactgcaacctctgcctcctgggttcaagcgattcttctgcctcagtctcctgaggagctgggactacagacatgtgccactacacccagctaattttgtatttttagtagagacagtgtcttgccatgtttgtcaggcttgtctcgaactcctaacctcaagtggtctgcctgcctcagcctcccaaagtgctgtgattacaggcataaatcactgcgctcggcccttctttactttcttaataaacttgttttcactttactgtatggactagccccaaattccttcttgtgtgagatccaataacccttttgtgtgtgaaagaatgtattgctgctgttcaggctggagcaagctggagctcatgctgctgctcagactggagcatgcgtgatctgtgatcccagtaagaggatcatggtcactccagcctgaacgacagcatgatatctcatctgtaagaaaaaaaaattactagagggctttaacagcaaatttgagcagcaaaaagaagtaatcagtgaactcaaagataggtcaattgaaatgatctactctgaaaaacagaaagaagacagaatgaagaaaaagaaatagagccttagagacaggggataccatcaagcatactaatatatgcataatgggactcctagaaggagaaaagtgagaggacagggagagagaatgtttggagaaataatttctcaaagcttcccatgtttggcaaaaaagcattaacttgcatacatattttaggagctcaatgaattccaagtaggatacactcaaagagatccatacctagacacatcataatcagattatcaaaagatgaagaagatgaatcttgagagcagaaagaaaggaacaattcatcacatacaaatagtactcaaaagatgtctggagtaggtatactaatatcagacaaaataaactttaagataagcattgttataataaataaagaaaggtattttgtaatgataaaagtgtcaattcatcaagaaaacataacattataaacatacatgcacctaacaacagagccctaatattcatgaaacaaaactgacagaattgaagggagaaatagaaaattcgacaataatagttggagacatcaatacctcactagttagacaagatcaacaaaaaaatagaagacttaacacttgaaaacacctaacctgaccctaacataaatctataggtcactacaccccaaaacagcagaataaacatccttctgaagctcacatgaaacatttttcaggatagactgtatattacttcatgaaataagtctcaataaatgtaaaaggactataataatagagtatatattctctgaccaaagtggaatgaagatagaaatcaataactaggctgggcgtgatggctcacgcctgtaatcccagcactttgggaggccaaggcggacagatcacgaggtcaggagtttgagaccagcctgaccaacatggtgaaaccctgtctctactaacaaaatacaaaaattagccaggcctggtggcatctgcctgtagtcccagctactcgggacactgaggcaggagaatcacttgaacccaggaggcagagattgcagtgagctgagatcgcgccactgcattccagcctgggagacagagcgagactccgtctcaaaattaaaaaaaaaaaagaaactagaaaaataagaacaaatcaaacccaaagcaagcaagaggaaaatgaaaaatttcaaagcagccaagaacaaaaggcacattatgtacagaagaacaagtgtatagatcacatatttctcatagacacaatataagcaaaaagacagtggagcaaaattttttagattaatgaaagacctacaattctgtaccaagcaaaaaaactccccccaaatgagggtgaaataagacaatttaatacagagaaaagaggaaggaatttatctagtcatatgtgagagttttatgatacattttgtactgtatatgtggatgttttctatttcatttaaaaaatcaaccgtgcaattaaatggtagattgtcttgcttctttttgattgacacagtcattaactaaaatattgtagtatttttttatctccctgcctaaaggcaataaacatctaatcagcagactagaacaataaaaaatattttttaaaagtcctttaggcagaatgataaaagtcccttaggcatattgaaattcctatttatacaaaggaataaacagtactagaaattgtaactatgtgagtaaacagataatattttttctccataaaatgtggttgactattttcacaaaaatagttaacaatgtaatgtgtgatttatagcatttaaaagtaaaacaggccgggcacaaaggttcgtgcctgtaatcccagcacttttggaggccgaggcgtgcagatcacttgaggacaggagttcaagaccagcctggctaacatggcaaaaccccatctctactaaaaatacaaaaattaaccaggcgtggtggtgcacgcctgtaatcccagctactctggaggctgaggcacaagaatcacttgaatccaggaggtggaagttgcagtgaggcaaaattataccactgtgctccagcctaggcaacagagctagactctgtcacacacacacacacacacaaaagaaaagtgtatgacaacaacagtgcaaaagaagtggaaatgaaaataatgttattttatataagtggtatacttttagatgaactacgataaattaatgatgtatactataaactctaaggcaaccactgaaataatgaaacgaagaattatggctaacaagccacaaaaagaaataaaatagaatgagaaaaaatatttaagttgttcaacagatgggaaaaaaaagaggaaaaagagaacaaagaacagatgggacaaatgggaaagtaatagcaagatgatagacttaactctacccatatagattatcacacttaaggtaaatgatctaaatactctaatacaaaagcagaggttgtcagattgaattaaaaaaacagacaacaacaaaaaaaagcaaaaaaagagccacaacatgctgcctacaaaaaattcactttaatataaagacacaaatagtctagaacaccatcacttttaaccttatttactcaaacctcctgatccctatttatttatttatttatttatttatttatttatttatttatttatttttgagacagagtctgactctgttgcccaggctggagtgcagtggcaccatctaggctcactgcagcctctacctctcgggttcaagcgattctcctgcctcaggcctcccaagtagctgggactataggcacatgccaccatgcccagctaattattatatttttagtagagacggggttttgccatgttggccaggttggtctcaaacgcctgacctcagcctcccaaagtgctgggattacaggcgtgagccacagcacccagctcctcttcatttattcttgctacgcttcctccaatccattttgtgcatttgatgattttgccagtaacttctttatttttctggtaaaattacttatgggtcactgaggactgggatgttctttcttctagagggggtttgtgtctgcttttgccaggaagctggggtaccaccagtcaagtattactttaaactcaattcatgaattgagacttttttttttttttttttttttacgcagagtcctactctgtcacccaggctggagtgcagcggtgtgaacatggctcactgcagcctcaacctactgagctcaagcaatccttctgcctcaccattctgtatagctaggactacaggtgtgtgccaccatgcctgactaattttttaaatattttttttagagatggggctcactttgttgcccaggccagtctcgagctcctgggctcaagtgatcctcccaccttggtctcccaaagtgctggggttacaggcatgagcctctgtggctagccaagactttttattttttagcctaaatgtgtataaaagttggcttgtggttacaacttatcaggattgatgatctctctctctctctctctctctctctgtctctccccacctctctcacatcccttgctctgctgagaagcagagcaaacattctagcagtttccagagagtaggatgggattacttctagtttacttttatcatcctttgggatcgcagtattactgggagaacacaagtatctcttattagacataccacctttgtagaatctggactttcattttagactttatttgttttctactataagcaatttaagttacagatctctctacacactgtttaagttgcatcccatgaattttgatgtgctttattgtcattattatatagtacaatgtattttgtaattttttgtgatttgtttggagagattgattaattagaatgatgtttaatttccaaatatgtgtgtttttttctacatttcttatttttattgatttcaaatttatttctactgtagtcagatttaataattcatttatttttattattttcatttttttagagacagggcctttctgtgttgcccaggtttgtcccaaactcctagtcccaagcagttctcctgcctcagccacccaaagtgctgggattataggcacgagccacccgtgcacaaccaacaattcatttaaaaagtgggcaagtgaactgaacagacatttctcaaaagaaggcatacaattggccaacaaatatatgaaagaatgctcaacatcactgtattagtctgttttcatgctgctaataaagacttaacctgagactggggaatttacaagagaaagaggtttaatggacttacagttccacatggctggagagatctcacaatcatggtggaaggcaaggaggagcaagtcacatcttacatggatggcagcaggcaaagagagagcttgtgcagggaaactcccgtttttaaaaccatcagatctcgtgagactcattcactatcataagaacagcataggaaagacccggcccataattcagtcacctcccactgggttcctcccaggacacatgggaattgtgggagttacaattcaagatgagatttgggtagggacacagccaaaccatataaataactaatcatcagggaaatgcaaatcaaaaccacaataaggtatcatctcaccccagttagaatggctattgtcaaaaaaacaaaaaataacaaatgctggtgaggatgtacagaagaggggactcttatgtcccactggtggaaatgtcaattagcatagccattatgcaaaatagtatggaagtgaggtaggttacatagggtggtcacagcctcccttgaaaggaaacaagaaacttgtcaaattgatggagagaacaaatctcttgacattacacaaactgcatctggggctagtggttagaatatcctcagtcaaggaggtagaagagcaggagggaaaatccctaagttcgtgcaagtgcagaaacccacaagctgtgttctcaggttgacatatactcattttaatagtaagaaacacacccttgggtagagaattaaaatgctaataatacatgtgatgtatgtactagcgtgtatggcaatattgcatgcacattcaagagaccacccaaaacatatttaacaacaatgcccattcccaccccctcatggataatcacgtaggactcccataacgggagtttcttcagtgtcaattggtgctgaagtagccgaccctgactctgctatcagcgtgtactttcaccttgcaataaactcctttgcctacttttactttggactggctttcaaattcttttgtgcagggaattcaagaatctgaaccagcctactgacaacagaggtttctcagaaacctaaaaatagatctaccagatgaggctgaaaatctgctactggctatttatccaaagggaaggaaatcagtatacaaagagacacctacatccccatgtttattgcgtcactcttcacaagagctgatatatagagtcaaccctaaatgttcattaacagacaaatggatagaaaatgtggcatatatacacaatgaaatactatttggccatgagaagaatgcaatcttgtcatttgtggcaacgtagatgaaactggagaacattatgttaagtaagataagctaggattggaaagataaatactacatgttatcactcatatgtgaaagtagagaaaaatttttagctcatggatttagagaacagaactgtgggtaccggaagctgggaagggtagcaaggaggggaggatagggagaggttggttaatggtgacaaaattacagctagattgtagaaatgagttccggtgttctgcaccattgtagggtgcatatggttaactctcatttattgtatattttcaaaaagctagaaaagaattttgaatactcacaacaaaataaatgataaatgtttaaggtgatggatatactaattactctgatttgattattacacattgtgtacacatataaaaatatcactctttatcccgtatatatgtacagttattatatgtcaactaaaaataaaagaaaaaaagaatatgatctatcatgatgtatatatcatgtgtacttgagcaaaatgtgcatgcagatattgtgtataatgttctataaatcaattagctcaagataatagataggattgttcagatcttctgtgtctttactgatattttgtctagttattgcatcattaccaaaaaaagggtgttaaactctccaaatgtgattgtagaattgtctattttgtcttttcttttccatttttactttatgtattttgaaactctgttatgacattttgctatgtattttaaaacttcgttatgtattttgaaactctgttgttagaatcatacatttatgattattatgttttcttgatgaaatgacacttttctattgtcattgtttttgttttttctgaaatggagtctcactctgttgcccaggctggagtacagtggcacaatcttggttcactgcaacctccacctcctgggttcaagcgagtctcctgactcagcctccaagtagctgggattacaggcatgtgccagcatgccaaactaattttgtatttttattagagacagagtttcaccacgttggccaggctggtctcgaacctctgacctcaggtgatccgcccacctcggcatttttattttattttatttttttgagacagagtctcactctgtcacccagggtagaatgcggtggtgtgatcttggctcactgcaacctccgcctcctgggttcaagcaattcccatgcctcagcctcccgagtagctgggattacaggcacataccaccatgactggctaatttttgtatttttagtagagatggggtttttctatgttggccaggctggcaactgactcctttaacaatacaaaatatcactctgtctctggtaacactctctgtcttaaactctattttagctgttattattatagccattttagtctttttatgctttctgtttgcatagtgtatatattttaatatgtttattctcaagttatctgtgtttttatatttaagatgtttctcttctagccaacgtgtttggttcttgcatttttaagtcgattctaacaatctttgcctttcaattgaaatatttacaccattaacatctaacattaacatttatttttctttccacagtacactggctagcatctcccatataatattgaacataaagtgtgataactgacatccttatttcattcctactctgagtggaaagggcaggggtggagaaagcattcaacaatttgccataattataatgctttttgttacactgttttcttctgcattaaaaaatatcattacattttgcatgaattattaggagaaaatattttccaattttcctggaaaatgccataaccacgtctctcaattttgtttccatctttcttccacattttacataacctacataagagacacattatcaagtatattttacatggcttctcagtgtcttctctgtctgctaacaggtttaccaagagatggcactcttgtatttctggtggctatgtccatatcgttttgcctttaagacagcgtaactacttctttcaccagtattaaagacatgtacatttgatctggttcttgtggatgattttaaatgactcaagctaataatcctaattttacctaaacactccattattttaaaatgtattcctttatgcccacaataaacatttattgacattaggctggacattaggcttctctatggcagacattaggctggaccctagccatatatctattgagggaaaaaaaattattttctatataagtttccagaaagccaagatgtgttttaaaaacaaaacaaaacattacattctaaatgctgtaacaagataagaaaaagtgttgaggctgagagaagaacaaagcagcaagcaactcctggaaggaccactgctgcagaggtaataactggtgaaccatgttttggagaaggaaaaggtcaccaagagaaggagggggtccagggtgttcagaaagattgcatgcataaagatcaagggtaataaaaaaaattccgtattatgtaaatgtgaagttccaggaccatgagcttggagagcatgaagtacaggaggagggttggtttcaaataaatctgggaatgaaacagtgaagcctctggcagaactcacatctctttcctcccctcttccttgcacattccctttatggagtaattgcagggatgggaaaagttcaaaaccaccactgagcctaggaagtgctagggtaaagtggagaatgaacctgcgtgatttgctcatcctaaactaggttcttctaggagagcccttccccataaaatctgccctcctcgaaggggcccagacagcctaagctcacctcccaaagaccccttacttgctgactgaatctgattccacccagacatggcctaaaacccttccataactctatagccaaattcaattttagacaggcctcataccaacctttcttcctctaagtctgccaccctaggcaattctcaacattctctacacactttggggccatagacgtgctaccaagtctccagacctagacctgatggagcagtgctgtaatgagacgaccactggcctttgaaccagacccttctctgtggctcctatgcatctccaacctgttttgagcactgctgccaagacatctttggcactttgttgtgaagttttaaaactgaactaatctacaaaacacctaacctttaaaaattcattgtcatttcatatcatgaaagataaagaaaggccaggaaactgttccaggttaatagagactaaagagatagcaaccaaatgcaatttgtgatcctggattgaggggaaaaagtgttgtcagagacatgattgggacagctggtaaaatttgaatttgaatttaaagataaagtattgagtaatataggaagatgattatctgcaactttcaaatgtttcagtaagtatatatatatataaagagatataaagacatataaataaatggataggtagagaaaaagcaaatgtataatattaacaatctaggtaaaaagtatatgagtgttctttgtactgtttttctgatttttctatatgtttgaaatcattttaaaataagaaggtttttgggttttttttgtttgttttttgtttttagagacagcatcttattctgtcaccaggctgtagctcagtggcccaatcattgctcactgcagcctcaacttcctgggctccagtaattccccctacctcaggctcatgagtagctggtacttcaggtgtgcaccactgcactcagctaatttttattttttaaatttttgtagagatggcatgttgctatgtcacccaggctagtctcaaactcctgcccccaagtgatcctcccactttggcctcccaaagtgctagaattataggcatgagccactgcacccagccccaaataaaaaagtattttattttaattaactaattaactttgagtcagagtttcacccttgtcacccaggctggagtgcaatggcatgatgttggctcactgcaaactctgcctcctgtgtttaagcgattctcttgcctcagactcctgagtagctgagattacaggtgcctgccaccatgcccagctaatttttatatttttagtagagacggggtttcagcatgttggtcaagcttgtctcaaactcctgacctcaggtgatccacccacctccgcctccgaaagtgttgatgagccaccacacccggtctaaaaagtattttaaaaccacagtcccactctaccttgtcctacactaccaggggctaggatcaccccatgtcttctaggctatgagatagaggaatccaaggaagaagataagctacttggttcctctatagggtcttgtgtgtgctctcatgtgctctctctctctctctctctctcacacacacacacacacacacacacacacacatgaataccagagctatcactttcccagtctagtactcatctcatcccaagggttttgtgttgtagtggtttgctcatttctttgttttgtttgtttgcttggattattctttttctctttttgcagctgaagggagaatttccaggccagccctttggccattagagttacagtgcctctattcaggcttcatagagagacctgggattcagtagtggggggcttttatccagttcaaaataatgcattctcaccaagatgtactttgaaataaaacaatactaaaacacaaaattttatttatgctgaacattgaatcacttttttctgtattttgtgtagaaagttatacacacacaaacacatttgctcctgctttgtttattggcccaggggtatgtttggtaatacttcatcaggcatgagtagtacgtcttggaaggtgtggtctaaagcctagactcctatctgcttccttcagcattctccagtgtatctgtcatctgtctaccttaggataggggtctccagaacttccattcacatttagaagagggcagcggctttctatggaaaatatgaactctcattcatctctattccttcttctagctatggtccagctcagctgtttggaataaagtatctatatgaagtctgcgaatggttctcagactggttgaacattagaatcacctgagtaccttctaaaattcttattacccagggcatatctcagaatgagtaccgcagggtagggataggattagggatcatgatctctggagtctggtttaggcactagtgctgtttaaaactacgttcatgaggtggaggttgcagtgagccgagatggcgccactgcactccaacctgggcgacagagtgagagtctgtctcaacaaaacaaaacaaaaaaaaccaactacccttgtgatttgaatgtccatccaaaattgagaaccattaggtaaggccaagctgtataattaaagagcagttttcatttgtctggtgtggtggcagctttttgataagggaagtattgttgccatccacatacctgagcctcactcctgagaacactggtgtgtatgttgctaaaattccccaggtgattctgaggttccttcctggataaaaaccactgaccctgggaatgtacccactgccaatctcctgcgtaaaccttggatactgggaagcctacagttgaaaatattgggcttgagatcctgaaacaaatcttgtatttcattaagactaatatttggtacagtgcagcaaatcaagggaattttggtggctgagttcttttagaacttttgcattgaaataggttcaagcagcaataagttaaaactacaacctcagctaaaggattaaaagacacgtgagctgggtaggatgaggtctaaggttgggtgtggcggctcatacctgtaatcccagcactttgggagactgaggtgggtggatcacttgaggtcaggagttcaaaaccagcctggccaacatggtgaaaacccatctctactaagaatacaaaaaaattagctgggcgaggtgccaggcacctgtaatcccagctactggggaggctgagggaggacaatcacttgaactcaggaggcagaggttgtagtgagctgagatcgcaccactgcactccagcctgggtgacagagcaagactccatttaaaaaaaaaataataataataacaataataataattcagacatatccaggcatcaaacagatacctggggcagatgaatagtcttgagattcaagtcacacatgaaatttaggtggaaaatgacattggagaaatttgagattatgatgaatggaaatttttcaaagaggaatttcaggctctgttcttgaggggatagatggacttccaacagcaataacacaggattaatgaggacttgggatgttacataaattagagatgttagatggataaagagataaaagtactctctctaagaacatgggaccagagataggctcacttctaaccatcagatataactagcagactaaacggtctaaaaataaaaatcatgccccactcctgcttaagacattttaattactctcagtaactcttcagtttttctactgtgttatctttaactacagggttggtctgggtgtgcaacacaagaaagcctggcatatacatggattcaagtgtatgccatgtgcaggtattctttcatgtactatttcatgtattctttttcacatctgttttttccttcattgaagtcaatggctgatattagattctactattcatgtgtactagttatatataattgttacaaaacaaattagcaaaaacttagtggcttaaagcaacacacatttattattacctaaggtctgtggatagaagttctgacatggcttaactgggttccctgcttcaagcctcatgtggctgcaatccaggtgttggctgagtctgaattctcatcagaggcttgattgtggaaatttccacttccaagctccctcaggtttgttgaaaaattcagttctttgcaccggtagaagcttcttggtagaggctgattcaacttctagaggctgtctgcagttcctgtcacccagggtggagtgcagtggagcaatcatagctcactgcagccttgacctcccagaatcaatctgttctcccacctcagcatcctgagtagctgggaccacaagtgtgtgccatcacacctgcctaaaaaacaaacaaacgaaaaaaaacccccagagaactttgtagagacaagctggtctggaactcctgcgctcaagcaattctcctgccttagcctaaaagttctgggattataggtataagccaccatacctggcatatggcaagtcttgagcaggacaaatacagatgatttatgtctgtcttccatggtattctaggttattgttgagatggtcctctattgtcttgttccatctattgattagataaaacgttgttccttctgttatttttcaacagtagcttttatgtgtctctctttatcttaaaattctaaccaaagagctgctcttttcttggtgtactttacctttggttgatccttcttaacctcttcttgccctctggggcctaagatgagggctgttatcagatgtgagtctatgggaaagcaagcaagaggttcttcagcctccgttcagccttaaatgtctaggtagaaatcagtcatggcccttccaatgtggtacagaccagatcacagagacaggggtctcagccaaggtcttgtggcctaagccttatagaaataatgagtgtttacttacttggagaactcccttggaatatctttttttgtgaacctgaggcaacttttggtgatttcttgatgtcttgggaatcttggtctagagccatttcaacccgatttcttttcatgtcagtggcattttgtgaccagatagtaaataagttctatgatgttcactcagagaaatacaatgacttatgatgcgaagcttctgtggttcagcccttacttcatcttcattccctcttatctgcatctgtctcctgcttgggaacaaaagtctggcttcattctatgacccccacgttgagtttcttagtagcacttacttttcaattaggagtgtcctcacttctatccgtcagacataactagccgactaaacagtctaaatataaaaatcatgtcctactcctgctgaaaacattttaattactccccatcatttaattttttctactgggttatctttaacttcagagttggtcttgtgtgcaacacaagaaaacctggcatatacatggattcaagtgtatgccacgtgcatgtattccttcatgtactatttcatgtattctttttcacatctgttttttcctctaaaatttatttccttttaaaaatgaaaattttgcatttgactaaatttgtcaaatttagtcaaatttgtttaaaaccatttttaaaatgtttcccgaagttttgagtgaagttagtacttcagaaaaactgttttgtatttttcctgtgacctcagtgcactgctgtgcatttccatttctgcgtccacacacatttgttttgaggaaatataggaacgacaagataaagttcaagctcctggacattgcataaaagaccgtcatgacctggtcctgttgacttccctagatttcccgctatttcctaagttgagatttttggtttggatgctttgtgttttcctaaaatcaaaataggtttttgccttttatgattatacagtaaataaatgctatttgtgtgaaactttaaacaatacaaaaaaaacctaaggaagaaagtcagattcatctaaaaatccttgtggccagaattaactaccttagttactattttctctatctctctctctcaatgtatatttggtgtaggtataggggtgtgtgtagtgtgtgtgtatgtatatatctgtttctattcctgtatgtggatgtgcacaacgcatcctgctttgtacactacagtactagcatttttctaatgtaattcaatattgttgaaaacattttaaaaaagcttgtatatatacacacacatacacatacatgcatgtatgtacatatacacatacagacaaaaatgtatcctatgtatattcacacatgtatacacactcacacatacatagagttttacatccatagtttataaatgttgcttttttttggtcacctttttgctaagtcttacactttttttttttttttttgagacggagttttgttgtcattgcccaggcttagtgcagtagcgcgatctcacctcactgcaacctcgacctcccgggttcaagcggttctcctgccttagcctcctgagtagctggtactacaggtgtgcgccaccatgcctggctaatttttgtagtttttttatagagacgaggtttcaccatgttggccaagctggtctggaactcctgacctcaagtgatctgcctgcctcagattcccaaagttctgggattacagatgtgagccactgcacccggccaagtcttacacatcttttttttaccactaaactgtttacccaaacctgataacccaagtcaacagctattatggctcacacaatcttatgtaaacaaagatacagatatatagaattttcttgattaatattcagaaaaaaatggagtccctttatacgtccttagtatctgctttactcatttaaaaatgtattacattatatgaaagtattcaggtcaaatgttatagatgtgattcattctttttaactgtgttatttttctgcaatgactatgtatcacaaagtactcagtcttccactgatgaaaatttgggctatttccagtttgtcttccatttttctttcttcctcttggattttcactcaatgtgtttactaatttaggaagaatcaatagtttttatggtattacttctcccattcaagaatatagcatatggtatagtatagtagagtacttagtttaatttagccagatcctgttttctgccctttaataaaattctatcattttctgcctttgagtcacattttccttgttcatataattcttaaaaaatgtatagttttcattctaagggaacataaaaacttctttccatttctattcctgtctagttaattctactattgggaaaagtaactgttaaaaaaaattcttatctttccagtcagttcaccacatttcctttatacctttgtactttaatccccagtcatgttgaacacttcttattcctcacaccaagcctcaacgggtttgctctttctggaaggtgcttcccctgtattactgacttattcataccacacatggagactggcgcagccctgttctgcctgggaagccttcccctgatacccccagttggcaggagtcttcatttgttcttttctagtcacctgtgcaagtttgtattgttcatgtttatcatccttcattctagttgtctgtctctgtgtgtggtctcattcagtggactctgaactcttatgaagtcatgtcatgggtcagatcttaataaattaatattgtcggaagctaatgtcatgtctagaatacagaaaatttatcaaaaaaaaatatagtatgttggctgggcgcagtggatcaagcccgtaatcccagcactttgggaggccgaggcaggaggatcacatgaggtcagaaattcaagaccagcctggccaaaatggtgaaacctcatctctactaaaaatacaaaaagtagccaggcgtggtggtgcccacctgtaatcccagctactcaggaggctgaagcgggaggatcacttgaacctgggaggcagagattgcaatgagctgagatcatgccactgcactccagcctgggcgacagtgagactccatctcaaaataataataataataataataataataataataataattgtatggaattgaactgctctgattggaaatagctgttttttaaaaaattattattttttaagttcctgggtacaagtacaggatgtgcaggtttgttacataggtaaacgtgtgccatggtgatttgctgcacctatcaacccatcacctaggtattaagtacagcatgcattagctcttttacctaatgttctcccacacccccaccccatcctcccccaacaggccccagtgagtgttgttcccctccctgtgtccacatgttctcattgttcagctcccactcataagtgagaacatgaggtgtttggttttctgttcctgccttagctgttaatgtcaggccagagaggcttaaatttttaaggatctctggacttttcttctacattactcttgatgtttataaatgttacaacttctttaatttcatttaatgtataccttattgagttgatttaactgagttaactttgttatatgaaaatcatgattgggagtgagggggttaaaccagctacagagatcttgattgttggtggtgaagcaatgcaagaattcattcattcagtaaactaatgtttattaagcgtgtactgtcttagtctgttcagactgctgtaacaaaatatcataaactgggtgacttataaacaacaaaaaatttatttcttacagttctggaggtgggaagtctaagattaaggccctggcaaatttagtgtctggtgaggacaggtagccatctttttgctgagtcctaacatggcagaagggttgaataaacttccttgggtttcttttataaggacactaatcctagtgatgaggtttctgccctcatggtataactactgcccaaagacccctccttctaatattatcactttgtgggttaggatttcaacatgagttttgagaggatacagacatttggatcatagcacacaccataggacagacactgtgccaagaattgtggatatagtgattctcaaaatgaacaagatcccctcagagagcttgcaaaatccagctataaaattatgctttttaaacaaattatgcagtttgaaaaatctactctgaatcttacttgtggcattgaatactttcggccactctttccttattatattaaatatttactcttgtttgggggatccagtctcacctactttttctaccagaactggtatcagctcatgctctgccttatgcaaattaagaaaatatcataccttttgggtaaattaagccaagaaagttctcctttcttctctttctctctttctttctttctctctttctctttctttctttctctctctctctttctttctttctttctttctttctttctttctttctttctttttctttctgacagggtcttgctctattgcctaggctggagtgcagtggtgcaatctcagctcactgcagccttgaactccagggctcaagcaatcctcctgagtagctgggactataggcatgtgccacaacatcaagctaatttttgcatttttttgtggagacgggatctccctatgttgctaaggctggtcttggattcctgggcttatgcgattctcctgcctcagcctcccaaagtcctgggattacaggcatgagccactgcccctggccattataactattttcattggcttatcaggcacatgataactataataaatcaataaccagaatttttaaataaagaaaggaaggaattgtttcaactcttcctgctacccctctatccctcaaaagggtaggctgaatgttgtcctccaaagatatccatgtcctaatccccagaacctgtaaatatattaccttatatgacaaaagggactttacatgtttaataagttaagaattttgagatgggcagattttcctgaattttgcagatgggccctagtgtaatcacaagggtccttataagagacaggcagaagagtcagaataagagaaaaatacttcaagatgttacactgctggctttaaggtggaggaaaggccaagagccaaaaaatgcagtggtcactacaagctgaaaagaaaaagaaatggattttcccctaaagcctctggagggggcacaaccttgccaataccttgattttggctcagtgaaacccattttggacttctgacctttagaattgtaaataaataaataattttgtgttgtttcaagccatcacagttgtggtaatttactacaacagcaataaaatagaattaaatacagagatctgaggagttgagtaggataagcctactccagcaggttatttcgggagtatggtgagactcactaggatggcggaactcaattaaggaagtctgaagctgataagccagagagggaaggctctcatttcattttataagggttgcgtcacactaggaagatccaatagcaaccacagtctcaaaattaatgattacaaataggacacaattccaagagtcgggagccaagcagaaaatggattagggaagacatggatgatatgaaacaggaaggaggggtacaaggcagcttcctgggaagttgccagggcagtcacagttcacattcattaggctgtgggcaccaaatgcatatggaaaatctagctgacttaactgaactcctgaagaggaatgaacacctcatttattgaggagctactaccaattagaatatgtatttcatttgttcaataaccccatgagtacagtaacacaatccttgctttactaaagcggaagccaattcaaagaggttcagtgacttgtccaagctcagggaaaacactaggaagtgaatatgggtctgactccatcactgatttcaggagccctgccctttcctccacaccatgcccccttgctttcagaaaaaaaggcttgttgactgaatggttgtatgcacagttcaaagcagaaacacacgatgacatcttttgagatactctaacagtgagaacttgaaaatgaagttaaaaattaagcggcaaaaccaagccgaggctttctgagaaagtggggccaaacctgttgccgtctgactgccacgtggctcactatttatccctgtaaaaatctgcaaaagtatttgaaagggaagaagggacagaaaactccctccttttccaagttagccttatagtctagggcttaaaatactggtttaatggtgaaggtaagtgcttttcttctttttgggtagaaggattattactaacttaccaaaggtccattaaggggagggaacagttttaggagaagtcagagaaaagacattaacagcaacataaggatctccatctggtaatattgcctaattccaaaatgaagagactctctgaaaaagataactgattcaatgaagaccctagggcaaggcttgagaagccactggtaccaatggacactgtggacaatggtcatttctccaaggacgctgtgagtattaactgtgatgctgtgattagtcagactgggattggctgtggaatgaaatactgatcagaactgacaagatttgtgtttgggactgtggctaacgagtcttttcagacttctatatgaatttgaaatggtctctcaggaaaaggagaacatggccgggcctggtggctcacgcctgtaatcccagcactttggcaggctgaggcgggcagatcacttgaggtcaggagtttgagaccagcctggccaacatggtgaaaccctgtctccactaaaaatacaaaaattagcagggcgtagcggcgcgtgcacctatgcgcatgcatagtgcgcgtgccagctattcagaaggctgaggcaggagaattgcttgaacccaggacgtagaggttgcagtagttgagatcataccactgcactccagcctaggtgacagagtaagactctgtctcaaaaaaataataataataaaagaaaaggagaacatgaccaaagttatgaataagactgaaggcaagaaaattgtacgcttgtagagatcacctagcttgttgccctcattgtacagctaagaaaaggcacccagggacattgtggtcagcaccaatttctcagaaagataggcagatgatgagagggccctcagtttttctaacactgaaggaattgcttctatgttttctggtgaactcctccccactcatcttgaggattccaggccagaagaatccactttaaaaaagaaacatttaaaaccaatttaacaaccaatcaaaggcacttttatagaaatacatttcatttgctgtaggcctgtatttatggatctgagagggctagactgccaatattgtgactgtttattattattgctgttgctagtatctagaatattatacaacatataacactttgcaatttacgaggcatgtctcatacttttgttttcactccaaactgcccagtgaagtaacattatcccaattcttcctatgaaacagtgaaagccctaagagtttttgaaactttacctggtttactcaatttgggaatggcagagcagaattcagtccttgaatatcctcccactgcaggttcatgctctttgatctaggtgtaacatttactctgagtaaactaggactctgggctaacagagatgaagcaagacaggctggatattaggagaatctaagagcaatctaacgaccattataataaaatcatgagttctagacttaaaaaaagggaaaaacctgtttttttgcttatgcgtataccataatatttacattatttatttttttctcaaattcaacctatactgtgtcaagtaattttttttaatataacattttcctttaacttaatttcaattcatttttctgtgtctacttacaactttggcactagaattcacaatttttttttagaggtatatctccttaaagggaagggttctgacactgttacatgttctcaattgtttgcaaataggttaataattattccagtgtctctaagtacatatcaaccatgccagtgttcagcctccataattttattagcttctgtgcttattttggaaaaacatttcccattaccatgaaagacctcagtttaggatggtttggtatgttagcctgatttctgcattcgtctcatgcaaaggaaaataggaaacgaagaactgaaattacctattgatacaaaatcaaagtagcatttgaaaccataaaacttaagtagggcttttcatcctttctcgttagacagcaacagagaatgggaagaaaaactaaagtgatgggtttgtgatacaattccagtaacataaagagcaaggagaagtagttttgttgtgtttatgtttaatattcaaagctcaacctaaaagtatttttcattatcaaacttccttctagaataaatgattaaaacttgatttaaaatatacaaattctcctttataatacctcaaaatggagctaccccattgagttttaagcttgtgattaaaatattacgaaaacaaaggggaagttgtaataggtagaacaagcagtagtctaggcattaggggatctggtgctggctctgtgcatcatgtggtttcaggcaacttttcaaattttctacgcaaattttcttatcaataaaataaacagttgggccagaggatctctgagtctctttcagctttcagtgtttataagattggagaagttggtgggaaagctttaagtggagtgtaagtaattgcagctgcatgtacagttaaagagttgccttcagccaagccacgggatcttgcataaaaagtgaaatcaaatagaaaatggtccaaactctgggtttgaccacagatgacttcagctaggatctgagtgtagagcaatgagctgaactcctgatatccagatgttagcaagacttggaggccttctaaggcagagcaacaaccagtatctgtcctggtgctgacctgatcttactagcaattgggcctccatttgggtccattgtacaaaacaacaacaacaacaacaataaaatctccaaacacccaaaattcaaaatttagatggagagatactattcccagaattctagagatatttggaaagcagaaaactatacttgccatgctgatgaagtccaattattgctcttttaaatacatttagctacttctgaatataaaatgagtatctactaattatttacaaaatcacttggtaaatatagaaagtcacaaagaatgaagtgatcatcctgttttgtaacccagaaatagtcattactggcacttgtgtgaatcagtttctattcctgtatgtggatgtgcacagcgtatcctgctttgtacactagagtactagcatttttctaatgtaattcaatattgtcgaaaacattttaaaatagcttccatcacaataatctatcaaattgacttgccagactctcattattaggttaatttatctctaacattatgcagtcatgagtaatactacaaaggatatttttggacacaatttttcatctatgcctttctttataatccttcatcctaaggtcacagattatgaatatctttaaagtacggacaagtcttttaaattttgtgtgcaaaaacagtgcaaagccttgaatgataaaatagaggtttgatatatgtgtttttttgtttgtttgttttgagacggattcctgctctgtcccccaagctgtagtgcagtggcacgatcttggctcactgcaacctttgcctcttgggttcaagcaattatcctgcctcagcctccttagtagcagggtctacaggcatgtgccaccacacccggctgtttttgtatttttagtagagatggggtttcaccatgttggccaggatgatctcgaacacctgacctcaagtgatccacccacctcagtctcccaaagtgctgggattacaggtgtgagccactgcacccggccgatacatgtgtttttaaagtcacagaaatttcagatgtcttgaaggattttaagcaatttaaaaaataaagtcatagaagcttcaatttaggaatgaatggaaaattgatgatattcttaggatatggatttttcctaaaagaaacaaatgtatgcatccccaaagataatttgattagtatacaaatattaaattaaacatgtccatatttagagccatgaattctctttgcctgtcacaatagctggatttattcacaattgtagtaattagtccctgttcattataattttctaggtgatatgaagactttgtcagtccaagcaagtgtccacattgtgtgtagcaaacatgagaataaacattttaaacttttaaatgtaatacatattagtgttatgtaatgtcatccttcatgttcgaaggcacatggaacattgttctggtggtacagaggggagagaaacaccatcagaatgaaaggaaagaccgctctggaaccttcctccttagctcttgagcttagtttaattgtcctgtcttatggtctgctacaagcaataccactcttcaccttcgcatgcttctctgtggtttgataaagtacatgcaatttttcatttaattcttccagctgcactaagaaaggagccttatctttattgaacagatgaggaaatgaatgattagagaatttaaatgactagctctaggtcacacagctggaacttacagccagatttccttttaacaatcctgtaaccaaaagcataccagtagtgccccataaaatgtaagttatagagctgtgttgggtcaaaacttttactgatgctaagaggaggcaacattaacaaggggaaattatttgtgtattatgttttggattatgttctctccatagataaaagactgtcgtagtaaaagagattcagggcacagggaaactccaccacaaagcgtggtaccatttcccacagaagctaaatggacgggaagcctgccaccaggaaaggtaaagccactgctcttgtttgcaggctatgttaataagctgaagcttattccgacacatttacacatctctgcatcacactgacccttcgtaaagatactcccagtgtaacattggagccagctccagcccctgatcctgttgctttttccttagccccatgaaatcatctgtgagaaattaagccaaataagcaataaatcctgggatctagggagtggaataagttttgggaaagtcttttttttttttttttttgactgagtcttgctctgtctcacaggctggagtgcagtggtgcgatctcggctcactgcaacctctgcctcccgggttcaagtgattctcctgcctcagcctcccgagtagcttggactacaggcacacaccaccatgcccagatgaatttttgtatttttagtagagatggagtttcgccgtgttagccaggatggtctcgatctcctgacctcgtgatccaccggcctcggcctcccaaagtgctgggattacaggcatgggccaccacgcctggcccgggaaagtcattttaaaccaacctatgtatgaatccctactataatattctcaccaagcggctggctctttctcctgagcttggaaacctccagtaaaatggaaataattatttcccagaccaccactcttatctgtgagcttttttggccattaaaaattatttcttccattatatttttatctgtgtcttcacaggttttctctttctttcactttagtgcttttcttcaaataagcaggaaaaatccaatctatcatgcacatgggaaccctttcaatattggtctgtggttgttccattttatggggatgcttttaaagaaaaaatttgtcctttcaatatattgaatatcttccagcaccacatcacctgcaagctttgtaaaaatagttctacatattaattttttttttttttttgagattgagtctcattctgtcacccaggctggagtacagtgacatgatcttggctcattgcaacctctgcctcctgggttcaagtgattctcctgactcagcctcccgagtagctgggattacaggcatgcatcaccatgcctgggtaatttttgtatttttagtagagatggggtttcaccatgttgaccaggctggtctcaaactcctgacctcaagtgatccacctgccttagcctcccaaaatgctgggactacaggcgtgagccactgcaccccacgtagtttttttttttttttaagttgaacatatgtgaaggcaggacctagtgacacatagcaataacatttccaagtagacattacactagggaattagtcgaagtgctcatttaaagtaccatctctcaaatgtattaaaagagaatccttggatgtgcaataccttaattcaaaggcagctcgttatgtataaactctcaagctttgtgataaacaaatgtgcataacagatgggactattcacttacagcccagggaattttattgacgctgagaaggttatgtgactggctctgccactgtcatccccattcacttcattttggagcaatatgacataaatgccttacatgtgggttttctctatttatcatgtgtttcctatccccttgaaagatggccatatttgctttacttggttataagatcccatattcgctgtcttgaagccaaccaaataatttgacaaagtgggtttgtagtgctggctattttggtgaaaaaaagacaatgagacttcatgtgtcatccaaagttctatcagatcgagctgtgagagaaaggaaaagaaaggggtctcagtcaggatgctcactacatacatctgtgttgttgtctaggtccagatttctgttcattacgctatgggctggctcttatcatgcacttctcaaacttcaccatgataacgcagcgtgtgagtctgagcattgcgatcatcgccatggtgaacaccactcagcagcaaggtctatctaatgcctccactgaggggcctgttgcagatgccttcaataactccagcatatccatcaaggaatttgatacaaaggtaagtatgatggaaaatagggctctttgttgagagaaaaaactttgaaaggaaggcatagatcttgattctgtggagtatggaagtatacatttccaatgacaaattaaaactgactggaactatttttctttgagacattgcttacttcaataataaaaataagatttcattgaggttattatgattataaggtgggggaactgtagagttaaatgtgaaaaatttaaaaatggaacagtttatgtgatgtcttcaatgaaaaactaggtattacctgggcacattcttataggttactcaatcctattcagttctctgcctgttttattgtttctgagcaattttatatccctgtaaattctatataaccaatagaaatgcaaacgattcttgtccatagctttgcaaataaattttgccaagagaaaaatcagttaaaacttttctccactcacctcccagttgaattagccaattttgctgtttgtttgtttgtttgttttttgagatagagtcttcctctgtcattcaggctggagtgcagtggcatgatctcagctcactgcagcctccgcctcccgggttcaagagattttcctgtctcggcctcccaagtagctgggagtaagggggcatgccaccgcggctggctaatttttgtatttttagtagagacagggtttcactaggctggtctcgaactcctgacctcaggtgatccacccgcctcggcctcccaaagtgttgggattacaggtgtgagccactgtgccaggctctgctgtatatttaaagtctatttcagcattgcttcctgcttgtgttatgcgtgattctttgagttttcctttgaaccagttataacatcttacttacttcctccattaatcaatgagttaaataaaatctttgttgtatgtttattttacatttatatgaaaaccatgaatttacccaattaaaaaaattatcctttaaattatcttgtactgtacatttcccatgtcatccctataattcatgattaatgattttattacattggacctagcttatttacaatgagtacataaatttattgtctccagtctttcctccattatcccgtctacatatccacactgagtagattcactactcaggaatcttggacaccttcaagttgccaaacatgcagtgttcactggacatgctgtgttccttcagaatttgggcctgcttctcagcacactcacatctgctatcaatgacccatggaaagtttttgccctgagcaagccagagtccctgttagtttcttccaaatgctacaagttcacttttgctattttttccgatgagataaaattttcctttttgactttctacaaatcatagtcatttttcaagggatagttcaagtattgcttcctttctgggaccttcccaaattattattttctcctctcaaagtctctgttttatttatgttcatcctcaaatcttgattctcacatgaatcatataccttgtattatttatagtttttttgagtgggtaaaatatttcatattttatattctttggctctctactttatagcatgatgccagatatttaggggccttattgcatttattttttattttattttaaaatctattttattttttatttatttattttaaaatctatttatttttaggtaaatattcaggtaatataatttatgtaattatttaggaattttaggtagttattttaaaataattcaaattatttattgagttatatcagaagaatgtgatcttattcatttgtaatatgtgttttaggaactcagttcagccagggcagaccatgattcccaaacttgacttttctttttaattaggcactgattttggttaagagttcagtaaagttttgtgtgtgtgttttaaaaaattctttgatataagagtcaagatgttactcaacttttactagaagcaaaatagaggaagtgctttcacagatgaaatatctctcaatgttttcttccatttacttcttcctattattcatctatataatcattttctttacctcttttcttcatttcttctgtttttctctccttctactaagacaagcaaattaggggtataattggttatttgggaaggtaggaagaatatagagagaaacaaaaatcaatattttatactagggtctcactaacctcaagcaactctgactgtaaagtagattttcataataggacttcttgacaaagagttttcctatttttcccccaggcctctgtgtatcaatggagcccagaaactcagggtatcatctttagctccatcaactatgggataatactgactctgatcccaagtggatatttagcagggatatttggagcaaaaaaaatgcttggtgctggtttgctgatctcttcccttctcaccctctttacaccactggctgctgacttcggagtgattttggtcatcatggttcggacagtccagggcttggcccaggtatccagatactttctcattcttggtgggatccagatttctgaattctacaaaatatcaaaggtcttaatgattttcatttcagggaatggcatggacaggtcagtttactatttgggcaaagtgggctcctccacttgaacgaagcaagctcaccaccattgcaggatcaggtaagtgtgcacagatgggtcatagctttgtcatctgttccatcccactgtgtcttatcttctatgaatcaaatggtttggggaagagagagaaaaagtactgctgaaaaattcaacaatataagacacttgcatcacaaataggaaagatgcatctgtgcagtaaagacattgaagcttagaagtagaaaaaaccattgtgagctaggtttcagctcagaaaagccttagtagtcagaaaagccttagtagtcagaaaagccttgtcggaaaaagtttaaacctttaagaattgcacacatggaaaaagatcaagtaagctatatatacaccatcttagcaatgattttgaagtgagaattaaggctaccacagctccaggtggtaaggagagaaatcaggctggaagagtttgaagtttctgtattattctaagctctttactattctattatgagctcattaattctcacaacaaccctctcatataagtaccattttaaattcttattttacagagaagggagttaaggaaggtggagattaagaaaattgcccaaatacaaatagccagcaggtggtaggtctgagatttaagcccatgcagattttagccccagagcagacattctcaatcactatgctagactgcctttccatggtatgtgatcctactcaggcctctacagctttatcattgctgttctccccagcctgtcgtgctgagagtatatactcgaagagcagaactaaaattccatccagcttctcactcctaggtccactacacagctgcatcctgcagacttttacctcaagcaaccctcctgcgttcttgcttccttccatcatagttgtaaccatctcctctatttgcaaatactatctgctgatctctctcttctagactggtttctttcaaccttcttcccaccaaaaccaagttagcttgctaaaataaagatggcacatttttactcacccgcttgagaattttcaatgtgttccttcatgcttacagagtaaagcctgacctctttattgcatgaatacaaaagttcttagccatctggccccaaccttgttccactcaactcccctgtgcaagcatggctccagtggcactggacattggctgctctccacatagatctgcactgcacttccctctggctctgctcccgttagtttatatgcctggaaagttctttgcccctgttccttgtgccaaaattccatctatcctattgcatagcttatgtaaaaacttcctaaaccttttttttttttttttttttttttttttgagacggtgtctcactctttcgcccaggccggactgcagtagcgctatctcggctcactgcaagctccgcctcccgggttcacgccattttcctgcctcagcctcccgagtagctgggactacaggcgcctgccaccatgaccggctaattttttgtatttttagtagagacggggtttcaagccaggatggtctcaatctcctgacctcgtgatccgcccgcctcggcctcccaaagtgctgggattacaggcgtgagccaccgcgcccggccaaaacttcctaaatcttataattattatcaatttatcctcagatatacttccacgtacattgtagttttattatatttatattttacatcttttttttcaaatttcagtttgggacccattagtgagtcataaaatccattgagcgggttaaaatcattattttaaaaaatgaatagaatagaatagaaattgttggagtgcattggacatggtaaagttaaatatcgattcatgaaaccatcgtttgaggcatatgtgtgtggttgtatgtacaagtgtttatgcatattggtgtgtgtgttatgttaccctgtaaaatgcatttcttactataggtctctgtgaaatatgtgtcttgttgttttttaatgtagacttccaaagcctacatggcatttcactagtgacaatcaattttattcacatttttctctccaattggaccagaagctctttgagggcaggggctgtatcttaccgatttttgtaagtctttcatttcctgcccctagcctcatattagatcatgcaagaatgcaactgtaatcacaagaaaatgctaatgggctgtgatagcagagagttactgtgacaaactaagggatttagatttggtcacattggtgttgaggagccattgaagaatcagagagtgtgttactattatttgttaattttaattatatcatattactttactggggaaaatctgtgagctattttagaaataaatactctcattgcccaataattctaagtctgccacctcactgttgggacattgtttagggaggccacgaagtctcagcctttgatattttcataagtgtttttctccctttttcctttagggtcagcatttggatccttcatcatcctctgtgtggggggactaatctcacaggccttgagctggccttttatcttctacatctttggtgagtcactttctcttaaatcctaacgcctccatttcctgagcatccattttggcacctacaccacccacattcttcctatatgaaagaaaatgtcctttatcaaatggaagatgataaaaaatgtcaacggttggtatcatttttaatctagtcacacaacctgattaacaccttcctggtggttctgggaagccacacgcacaaggtagaggagttgactattcacatggcacccaccgacttgtgatgcagtcttgtccttccatatcaagcaccttctgcagaatctctaccaccacatctgaagtgcctgctatatgcagttaagatgtcaaagatagtgaagtacattttcaatgtgtcttcatatttcattataattattatttctgtccaagatgcctttcacctgttctctaccaagttaatcttgcaaagttcaattcaaatgttcccttccccatgggcccttccagggcttaccctatcagattctggcattctctcctttatgatatttcctctctaggttatgttggtgtgtaattatttatttctccttttctttccactagactgtgaaatgcttgaggcaaggaatccattctatgttttcatcacttgggtgtcatcatggtgcctgatttttagctttaaaataaaagaatcagtgaatccagtaattagaggggatttaaagaaaactagtcctcagaatcttttaacatagaatgttcttcaaataaggaattccaataataagacaattttctacacttgattttgtttttatagccaaatggtgtcattaaatatagtcctggcctgaatggctttctcattaatgatgctaattattttggtttgtacatgttaaccaggtattgtacaaaaatatttcttttgggaatccataatggatgtatggcttgaatacaaataatactgtctcttgtaagtgcattggaaatttttccctgccacatgatttcatggaaggttgtttcgtgtatgtatgactgcaaacctgactattcagatcttccgcaacaagacaacttatgtgtgcattaagaagttgctgcctaaaatacataacactgtaatcattggagactttaaagtaattaatcagctatgcaatgccacgctcctgttatctccagagggctctgacattgacaaatggtggctttctatttgagacgtaatatctaaaaagctttaacaggtttgtagaaggattgaaagaaagaatgggaacatttaggtccttatggtagaataagcattaattgattagtgtgtagaagggagaggcatgccacttcagaggaaacttccttcccccagtaaacaaatctacctaaaaactaattttatcccttcttcccaggtagcactggctgtgtctgctgtctcctatggttcacagtgatttatgatgaccccatgcatcacccgtgcataagtgttagggaaaaggagcacatcctgtcctcactggctcaacaggtacagtgcacaccttgtacctgtggcccatgcagaggtctctagggcagggtgtggatctcctctgagaggcaccatcttggctgctctaatactcatgctgattagatctttcttttcagcccagttctcctggacgagctgtccccataaaggcgatggtcacatgcctaccactttgggccattttcctgggttttttcagccatttctggttgtgcaccatcatcctaacatacctaccaacgtatatcagtactctgctccatgttaacatcagagatgtgagtttacttcctatacttctacgaaaatgataatggtaataaggagaaacagttctgtgttacctattacattctggctttacatataaccattaatttaaccttcacaatgaccttgagagaggcattgttataattcccttttcacagatgtggaaacaggacacttagaggtgagataacttgccccaggttgcacaatactaagtgatagagctgctgcagcatccatattcttaaccactatgctatactaccacaccagctgattccaaagcttcttttagaaataatattgctgggccaggcatggtggctcatgcctgtaattccagcactttgggaggccgaggcaggcagatcatgaggtcaggaatgcaagaccagcctgaccaatatggtttactaaatatcatctactaaaaatacaaaaattagccaggtgtggtggcaggcacctgtaatcccagctattcaggaggctgagacaggagaatcgcttgaacccaggaggtggaggttgcattgagccaagatcatgccactgcactccagcctgggcgacagagtaagactccgtttcaaaaacaaaaaacccaagaaattaatattgcttttatctggagcccagagtgatgcagcttctggccctcttatctgagacagtgttcttttagtgtgaaaaaggatgctaattttcccccaaacaacccacagtatcatgggggtaagttaatggctggtctgtgtaactgacaaattttggtgctaacgtatctctataactactctgtataaacttccttccttcagagtggagttctgtcctccctgccttttattgctgctgcaagctgtacaattttaggaggtcagctggcagatttccttttgtccaggaatcttctcagattgatcactgtgcgaaagctcttttcatctcttggtaaggataagcgtgtgggcccatttaaccaatcccttttctgcacatggtctcagagggttccctgacagcatgtcctcattgcccagggctcctccttccatcaatatgtgctgtggccctgccctttgtggcctccagttacgtgataaccattattttgctgatacttattcctgggaccagtaacctatgtgactcagggtttatcatcaacaccttagatatcgcccccaggtaagagctctacctgttttttcccctcctccagacccctccagaggtgttagacctcagtggtcgccgtgaaactctttaatgttactgacattgcactaatggcagaatgacaaataactacaaatatctgtctgtggccatttttagaacaacaaatgtggcatttttagaacaacaatttccaatcttggccagtaatcattttgacaaaaaccttcccaagcttccctaacagagattgaactgtgtatgctgggaaaaggcccacacacaggtgatttggaaaagtttccatggtgttgttcatattagctaccatatatatatatatatatatatatatatatatacagtcacaataagccagctcctgtgccaagacttgccatatatcaacacatctaatcctcacagttatattaggtaggccctattgttatccccattttataagggagaaggctgaggcacaaggaggttaaatggtgtgactatggtcacataaaggcagagccaggatttggactgggggagtctggctttggagtctgtgtcctgcccgttgcacaaactggcttctccactgagcagccggggtaaagaaacgtggttcccagagagactgcattgctccctggttattgacttggtagattggtaatttcaggtttggcaaatagacattgccctgaatgtctttaggtgaatgaaaaactgcattaagcaaaatgactttgccattagagctgaattgcattaaagttgagttgctgcagaagctgtaggtggctttctatataaaatcatttataaaatcatcttcccacagatatgcaagtttcctcatgggaatctcaaggggatttgggctcatcgcaggaatcatctcttccactgccactggattcctcatcagtcaggttgggccagtttattgaacatcttcaagtggcaggtattgttttaggtgttggagatacacacggtgctctaaagatctggatggcaacacaattactctatttacatgagcctctaaatcagactctggtaggtcagatttcccagaggaagaaaaatataagcttattttctcaagatgaatagatgttagattgattaaaatgagctgttccggtgcagaagacagcacgtgtgacttcctagaggtacatgagcatgaaacagttcttagttatgaccagaatgaaagacacatgtcaaggaatagcaagagacgaagacagaggggcaaaagaagatcatgaagaatatgttcagactaatccaatttttaaaaaatcacaaaagggaaacaaagtgtcctaggccagtttaaagataatttaatgtctggaaacagatcggctgtgagacattgcaaggaggcttgctcggtgtttggaaatgcaggctcatgaggaagatgaaaagacagacccaggcagggatggaaggactgacgagaaccaacttacaaagagaagttttgtttttactacatttctatgtgatcaagttcccaggttaatatttgactaaactgctaggaatccactgtgactataatgctggaaatgacttagtagggctttctgaggagggtcacacagaagaccaaagagaactcatgttgaattgagatgggttgtagtgatagttgtcaacagccaatacagaaacaaaaaaaaacaaaacaaacagcaacaacaacaacaaaaaaaaacagagaagacacaaacacaatgccacaatgccattttaggcataattttaaatgagtaatattatatgttgaaatccaaattttcagaaaaacattagtgtattttatttttgtttaaagaaataaccatctcaactcagaaccccatgtgcattttggccattttgtttccaatagtttcataaactttcttaagtaactactgcacattgttccttatattccttgtgatcaacattgcaatacacaactgggagggctactagaactggtgtagaaggaacttgtgagattgatcattttctctgttttttacatctaggattttgagtctggttggaggaatgtctttttcctgtctgctgcagtcaacatgtttggcctggtcttttacctcacgtttggacaagcagaacttcaagactgggccaaagagaggacccttacccgcctctgaggacataaagttacaaacttaaatgtggtactgagcatgaactttttaaacattttttacttctctccatattcctgaccatagactcagcagttcttaactctggctgtgtgttagtcttccctggggagcctttataagacactgatacttgggacccactccagagattctgaatgaattggtctggggtggaacccagatactactaatttttagatactccttagaggtttctagcatgcgcccggggttgacaacagctggacaaacttgaaaagtcaattcatgtggcctttgaattttcctcattggaaagtactaaataaataaaaattcatgtgaaaatgatcactgataaatatcttcatggtggggcaggttattggatgcagagaagatctgctcggaattgtagccatatgttacagatctcagcaccgatcggaactgtaaagctataatccccagaattaaagtttttattattttttatacattgtaaaacatagacgtttatttatgtgattaaattctattaaaatttacatgctaaaataaaatagaccattttcaaattatttagatccagatatttccatcagattaaacagatatttatttatcctagcccaattgcaagagattaatgatgagaaaatgaccaatacaagattaaataaatgaggttaacttagaaatcaaggacagagaagatagaactggaaggcttgtattgtgagaagaatgaatgtgaaggaaggcaatgtagacacttccagaagggatagcaatatagtttagaccatataatgaaaattggagagagatgacagagacactttcaagtgaaatgacaatttatatgggggagaaaaatattgaagacataacaagatgagaaaaggcatagaaatgtatcacatacaaggcatagaagtgtatcacatacaagagaagttccttttgagcgtagaaaaagataatttaaccttcttcatatttttcttactttcccaagatactcagataggcagcgtcaactctaacaggaattaatttggctcctaacacttaagacatatcctttagtttgtctcctcacacagaactgattctggttttgccacaacatgtctagagaagaagttcccaccatattttaaatcctattaaaaaactgcttggacaagaaccttgggttaattcagcagatgaagagaatctcctaatgcaaatcaatgggtatttttgagcaagtttttcagaaaaacagagtgtcaggccctgagggtggtactaagatgagaacattgattttgccttcatgatattgacaacacaaagaggaaagggggtttgcagaaaactaaaagaagaagtagaagaaaaaagaaagacatagtataataggtagtcaaattatgtacagaaaaaagagaaaaaaaaaacaaaaaagggtgggggacagacaacccaactaaaaaatgggccaatgacttgaacagggacttcataaaagagaaaatgtaagtggctccttaacatataaaaagatgttcaacttcattagtcattacagaaatgaaaatcaaaactacaatgaaataccactataaaattaactaatggataaaatgaaaggagatggaaaacaaaatgttgccagacatgtggagcaactggaactttcatacgttacgaatgtgaactttggaaagctgctcggcaatatctcctaaagctaaatgtacaattccagtgactcaaacattttacttagaaatgcacatatacatccataaaacatgtacaacaatgttcataggagcactatctgtaatagcctgaacaggaagttgtctgttaaaaaaagaatgagtaaataaaccacggtctatttgtatagcaatgagaattaacagaccccaatatataatagatgaatgggtctcataagcacaatattgattaaaggaagacaaaacgcacattcttttaaaggtttataaaatactttttaaaaacagctacaaccaatctgtcctgttaaaaatcagtgagcgatttcccttgtgcagggatgggggttgtggctggatggatggtacttaagaagtgctcctggggtactagaaatattttatttcttgacttggatgtgtgtttactttgtgaatattgtacatttatgatttgtgcacgtttatgaatgtagaaaataaaacagaaagcaaattcaaagtatcatccttttgagagcttctgctctgacttcgttttgaccaatggagcagttgggaaggggtcttggtccttcggtcctttgctttttttttttttttttttttttttagacagagtcttactctgtcgcccgggctggagtgcagtggctcgatcttagctcactgaaagctttgcctcccgggttcatgccattctcctgcctcagcctccccagtagctgggactacaggcacctgccaccatgcccggctaattttttgtattttttagtagagacggggtttcaccatgttagccaggatggtctcgatctcctgacctcgtgatccgcccacctgagcctcccaaagtgctgggattacaggtgtgagccaccgcgcccggcccctggtcctctgctttcatgttcttcttggtcctgttcctcctcctcttttgttggaacttccagtatcagagcaggaaggaaggcaatgggtcaatcgatgctgtcagcttttggatcaaactgcaagttctcaaacagcaaaattaatgagctcaggctttgaagaaaccatgaccctgaaagcatcagttgcttccaattgcatcagttgccacgggtgataagaacaatgatgactcagaatgcctaggttttcccagcagcttctctgaggttttcccagcagcttctctgattgattcctgacagatgacttcggtgtgtcagactttcagggtatctttccttatgtgatggtttgaggaagagttaccattcacattcctaatggcttcagaatagatgcaattgtgaactgataggaaacatttctaattcatctcccctccccatccctaaaggattgtttctaacaatagtcatgaaaattaattcacttttctcaaatagtttattgtcatctacctaatgatgagatgacttactttttctccttgactgttaaatattatgaattatattaatgtatttcttaatgttgagctttcccttgaatattcttttgatgtacgacagaatttgattcactaatagtttatttaggactttggctgatgtactgatatatgagattggctctgtatgcatacatgtgttttgtgtatcttttttgtgtctggatatggagcttatgctgatttcaaaaacaagaaaggagaactttcctttttccccattactctgaaaaagattgactagaatggaatttttataattgctgttgttatttgaaagcttgaaagcattggtttgtaaaaatcatgcaggctgaaagccattttgaggagactttgataactttctcaatttccttcagttactggtcttttaaggggttttatatttttctttgatcaattttgaccatttatgttatcttggaggatcatctattttacacactatttaaagtatatttgcaaaaattcaactgttttatcaggctatctttttaataatatattcattttatctatatctgaggttttagcttctttgtacttctgacccaattgcatgtgtgctttctttctccttcattagactacttagtcatttactaattttaagaatagcttgtcttttatttatttacttatttatttttgagacggagtctcactctgtcacccaggctggagtgcagtggcgcgatctcggctcactgcaacctccgcctcccgggttcaagtgattctcctgcctcagactcccgagtagctgggattacagtcatgcaccaccatgtctggctaatttctgtatttttaatagagatggggttttgctatgttggccaagctggtctcaaactcctgaccttagatgatctacccaccttggcctcccaaagtgctgggattacaggcatgagccactgcgcccagccctgcttgtctttttattttatatttgattagctttatcttttatcaagcttatgtcctatttccctttgctttacttcatataaattttgttttggatagtttatttatttttcatttaattatgaaacaggttaaagcttagaggaaaattgctcctctaagtccaattttgtgggcagattacattttgctgtgttgtgctcccaaattcattgttcttttaatgctttatttctcaagttaataacctatatagtaaaaaagtggctgttgactctcagctttttttttttttttttttttttgtagatacagggatcttgctgtgttgctcaggctggtctgaaactgctggcttcaagggatcctcctgccttggtctcacaaaatgctgggatgacagacatgagacaccatgcctagccatgtctctctccttatatataataagaaaacagacacactgaggcatcctatcatctcactcttggtttcactactgttctctggaagttttgctctgaccttttgcagttaatgtattaattttgcattgagtagtttccatagaagaattatagcatttgcattctgttgggtattatacttttcactgttatttgaacataatttgagggctgaaaccaagatgaggcaagtgaggtgcccaggaagcaatatttaaggaggcatcctttcttaggctcatgcaagaacagaattggcacatgagagtgagtgcctccttaattttgagtgctggacacttcttgctcacttagcatacccctggacaatgaagtgttttttgttttgttttttcatgtccatcctttatccttcttcatctcaaaacatttcaatggagtatttttttggagcagtacttggatgagcctctgagtcccacagtagctgagaatttatttcatagtactctttatgatcactgtggagccttaaaacattgtaatattaacttagctgggaacagaaattttgttccacaatttgtcttattcagaacagtattgacttcctgctagtctcttctgatgtccaatatgaggaagtctagttagccagctactttttgtaggagagctatgtttaggctaggtgctataggattctctttatcctggaattccttcaccaagatgtgccaaggtgttaatcattttctcttgctttttggctggtggtcttagagtttccttcgattttgttttatttagtgattgtcctcaatttgttttctttactaagaatctctcttctatttatctgtatggtaaaaccttgttgcccatctttctggtttctgctgactttcatttttggaccttttactttgctttctccatggactttttggtagtggaggcaggcaaacactttccaaagtctttctcaatttccatcaatttcaacttatttcctaaaattgcctcagaatgtgcctatgtccacaatatccctccttccactttagaaaggaaaggcatccacactttatttaggtgcaatgcctgaagtgtaaacactttctggttgtcaacaaaggagtacttccaaatattggtttggggataacctgctaatgattaacacattcaccttggctcttggtttgcctgctccctcttcttttatctgctgtgtgtattttttttaatcactgagaatatgcacagtattgtatgttttattataagagaggactggccagagtgggaatgttctgaattcagaataactgaagcagtacaggataggaactcattctttcaaatgaagctggcatattttcccagagcaccaaatttcaatatatatttaaaaaacttgatatgaatgatacaataaagtggttagaacttttattaaaataaacttatgtcatgaaatacttattctaattatagtcactcttcatcttatttcatcttataacatgtttaatgttttcttttatttacaaaacaatttattttttgatgaaaagttttagaaatcaagttaaaaatattcaaaggaatgcctaaagttttcaaaattcttttacatgttgtacaatcaaaagagtctgaagaccatttagctatccaaattgtttatttttaagcagtatcccttctaatatttactatttataatccttaaaaatttgccttagcacaggagaattgcttgaacccaggagacggaggttgcagtgagccaacacagtgccactgccctccagcctcggcgacagagtgagactctgtctcaaaaaaaaaaaaaaaaaaaaaaaaaaaaggccaaaaacaaataaacaaacaaaaaaatccgccttaacattatttgttcattaaaaactttctttaatactactagtttccctttcctctcagcccattgtcatattttgatttttatcacttgctttgtaggacatatgaggtttttgtttttttttttttttggagatgcagtctccctctgttgcccgtgctggagtgcaatggcgcaatcttggctcactgcaacctctgcctcctgggttcaagcaattctcctgcctcagccttccaagtagctgggattacaggcacccactaccacgcctggctaatttttgtatttctggtagagacggggtttcaccatgttggccaggctggtctcgaactcctgacctcaagtgatccacaatccttggcctcccaaagtgctatgattacaagcatgagccacctgcccagccagaatatatgttcattttgagtcctttaacaaagtcataagaattttaggaattcagttactttcttgagaaaatctctgaaaagatgccaataatttgtagccaattatattgatttctctttttcatattgagaattgttttttaaaaagtttgtatgtgtgaagatttttgcactgtagttaaagaaaccacctgtgtgttggttaagccataagtacatgtattcaaataaattgaggtggggttactctgagaatcaaaggaaaacctgaagaaacaggcagcctcaaaaggtcttagctgtagcaacttgctccattgttgaaataaataggcttgaacttgtattttccctctactcaacatttaaggtctcagaagataatataattggtgaaatttaagtaaagtgctcactcttttgctttaacaaaccctagagagctggtaggcagagcctcaacagaccgttttagcttccaaagggagttcaggacaccatgattcacgaccacaatacatcacacataattgagaaaagatagttccaccaaataaagttgaaatgctgacaagaaggggtaagaaatcttggaaataagtttatataaaatttattttttccttttttattgttatggaataggaccagttctacttaagccacccatttgccaaaataaagtgagaatcgtttcttttggggactcctctttgtagctccaagtgccactaacaattcttaggacctgagctataagccaggtgatttcagttaatatgatcaattatttcatttaaatggctctaatgtgcagagggaacggagcccatcagcattccctgcagggaactgcagtggcttttatcaacttgaacagctagctttcaactgttttgaaatcactttcagggtggtcatgtagttgcttttttgaaatcagaagatgattctgcctcttttaatatgtgactcctcagattcagaaagtgctcgctagtcttaagagtgaattaccctcagtggtccagcgcttatgaacccacatctaaccctatcccctgggggaactatcagagaaattggtgccatggacataagaggaaggcacagtgaagcagagagccccgcatgatgaaaatcagtggacagcatcattatttacaactttgtaatcacccaggagcatgaaaatccaggccaatctggcaccatgagctctaatttttgttggagttcttggaaccgattctgatgaatgactgtttagccattttagagtgtggcatacgtggctgctggcatacagaggttggatgtaaacgggcctttgccctctcttatgaacatagacaggaactaaactgtgtcacataggttccaaatggtggcctgaatactatttacaactaaggtacaatgaaattgagtaagtcttttcctcttttgcagataccatcattattcatatatttcttcaaagttaactatttgtatttggtaatttttaatagaaatgtaataattgcttctcaagtttagtctttagtcttaaggttgatgctctccatgtccttccaaaaaaaggtatgttgcttttattatatcctcgccttcagatgggattattccattttgttctttgttaatatatactttgagccactttttttgtggctctgggtgagatgctataggtacaatgacaagtgatacgtgtgttgtccctgtcacaaaagtggatagcctaagtggtgacttttacctccactccaaatatatgtatcacacaccagccgtatgccaggcaccactctaggtgctagggatacagcagtaaacagacaaatgcaacccctgcccatgtgaaagagaataagacaataaataagtaaagtgcatgttatatggaggtggcaaatgctaaaaagaaaaattaagcaggcaagaggactcattgaaaagatgacatttgggtaaaagcccatgtatatatgttctattggttttatttctctggagagccctgactaatacacaatgactttgagaagttactggcttttgatttatcacactattcggagtgctgagagccttcttagtgtgtattcagtgttttaagagagcttgtggatgaataataaataggacaaaatttatccaaacttaagccttgctttaggtaaaagggctcctcttacaaggtagaaggttattatttggcatttaaatccaactgaagactaataagactaattaattaaaagtttttaaatcacaactgggtgcaaaataaatggaactgccatgctcgccaagtgtgcatgagtggtgtgcatgggagacagcacgaagctaatcccactcatcttgcaggttgctccatttttctcctaaaatcagtaagacagaagctggtcagattatcaagagccctagttaaacacagcagtagcatttggaaggggttgctctcattaggcagtgcctgaccacaacaagagatgaacaagccctgtatctgaagccatcatgcctagttatggtcccccactgttcatgatgcctgaaagggaggccccctgcaccctagaaagctgggtgggttctactgtctgctttactgctaaaaaccctcttctttggatctggactttacctctatctgatttttttttctaatatatgatttggcactgagtctgtcactgctgctaactcagcagttctagggtcattgccccattgcctcacagaaagaatttcatagcttccagcatcctctctccttcattatactttgatttcagcattgctattttttctcttgggtgttgcagctctctctctccttcccatgtcttgttggttttctgctaactcctgctttttttctttttttttttttgagacggagtctcgttctgtcacccaggctggagtgcagtggcacaatctcggctcactgcaacctccgcctcccgggttcaagctattctcctgcctcagcctcccaagtagctgggactacaggcgctcaccactatgccccactaatttttgtatttttagtattgctgtcatcaatccacatgtccagaagcacctagaaactctaattctttgtaggtatcaaaccctaggactctttcctctaatcacaatatataatccctgattcccaaacacggtcttttcatatacattttccactgtacatactttctgacctggaaagctcttacacaaacacgccctcccctaggaagcctttataaatgttcccaggaagaatcagtcacccaacagtgtccttgtcacatcttaggttctacacctttatttgttctatctgaatgtaatctcccagagggtgttatcatctttttttttgagatggaatcttgctttgctgcccaggctggagtgcagtggcatgatctcggctcacagcaacctccacctcctgggttcaagtgattctcctgcctcagcctcctgagtagctgggattacagacgtgtgtcaccacacctggctaatttttgtatttttagtagagacagggtttcaccgtgttggcaaggctttcctcgaactcccaaactcaggtgatccacccgcctcagcctcccaaagtgctgggattacaggtgtgagccaccatgtccagccccatctttttcttttagtttagttcttaacaaatagtctgacacaaagtggatataacaatattttgaattatgaataactaaatgaatatttccagatttcctggtgctctcaaagttttatgttacaaaagaaaaacaagtctaaaatacctgcctcaagtttttatctgtactatgatttcaaaccaaataaaaaacaggtggggtaaaaactgaaacaggaaatacatataactgaaaaattttggtatgttagtatgataatactaggtcatttttcctgtttccccaacttcattttctatagcaataaaaagaaacaagtaaatgtatattaatttaatttaaaagaagtagtctaccatctcttctgttaaaaagaaaaaagtattttaaaaaattatctctggaaggatacacagggaacattgctctggtttcttccaagagagaaatgaggaactagagagcatggccaagtggggttttgcttttgtttttgtttgtctatctgttagctttttattattttcttttgtaggtttgaatttcaaaccacataaatctgttacatgctcataataataagtttaaaataaaacttttggctgggtgcaatgacttacacctgtaatcccagcgctttgggaagcagaggtgggaggatacttgaggccaggaatttgagatcagcctgggcaacatagtgagaccctgcctctgtagaaataaacaaaaattagctggatatggtggtgcatgcttgtactcctagctacttgggaggttgaggcaggaggatcctttgagtccaggagtttgaggctgcagtgagctataatcacccactgcactatagcatgggcaataaggtgagaacttgtctcaaaaaaaaaaaaagggggggggaaacaaataaataaatataaacaaaacttttgtttcaaaatatgtaatatttagcactaaagaattctgaattgtagagctaaaaagtacttaaaagttaataattattgtctcctttaaaagaattgttatcaaagtataatttttatccagaaaatcatccatatcagcaagctaaactttctcaaaatgacatatccatgtaattagctcccaggtaattagcaggcagcctctactcaggttgagtattcctaatctaaaaattggaaattcaaaatgctccaaaatcggcaactttttgaatgctaacatgattctcaaaggagtgctcatggaatatttcagattttggatttttggatttgagatactcagtataatgcaaacattccaaatctgaaaaaatctgaaatacttctggttctaagcataagggatactcaacgtgtgttagctaattagacccttcatggtctcttctagacctcagcttcttcaaggtaacctctatcctcacttctaatagcatgaacttttctgttttagaataatttggattttcaggaaagttgcaaagatagtacaaagacagtacaggagagttcccatatatctttcacctagctttcccccattgttaggattttacattattatgatacatttgtcaaatataagcaactcacattgatacatgaaactctattaaccaaaccctagactttatgtggatttcaccactgtttccactaatgttttctttctgttccaaggtccaatctggaataccacactgcattttcttgtcatatctccctagtctttttttgtctgtgacaatgtctcagtcttttcttgcttttcatgaccttaacagtcctgaagatcatttgcttttttttcataattacaccggagttatagattttttgaaataataccacaagggcaaagggcccttcttgtcacatcattttagggagaacatgatatccacatgacatcactgatattaaccttcatcatgtggtttaggtaatgtttcaggtttctctactgcaaagtgatttttttcccttaatttagcccacctgaacttatcaattttgttttcttccatgactaatacttttgttattatagctaaaacttcattggggccaaatcttagatcatgtaaattttcttctatattttattctaaaagcttgtaatgtttgatacattctaaaagatgtaatgtttgatacattacatctagtcctttgatttatttttagttacttttgtataaggtgtgagagatgtctccagtttcactttattaacacattgtggtgttccagtactatttgttgctaagactatcttttttccattgattacctttgccttagttggcaatatttttgttggtttatttctagactgtttatctcattccactgatttgtgtctatctttttgacaaaactgttgattacagtaagctttgaaatagttcattttttgtgtcaacttgactgagtcaggggataaccagctatctggttaaacattatttctggctgtgtttgtgagcgtgtttctggatgagattagcctttgaataggtgatcctagtaaagtaaactgtctttcccagtgtggatggcattatgccacctgatattcagggtctgaatagaagaaaaggcagaggaagggggaatttgggcctttttttctgcctcactgcttgagctgggacatctcatctggtctcctgctcttgaactgggatttacatcatcagttcctctggttctcaggccttcagattcagactgaatcataccaccagctttcctgggtctccagcttgcagattacagatcatgggactcctcatcttccataaatgcatgagccaattcagtctatgtccttgaaaactgccccactgcagattaaggcttttttccactaggtgaaataaagaagcttgttagacagatttcccttcatccagtgccctctcctctttaagttacaacacattggctacacctaagtgcaggggtggggatgagggtatagtcctcttgtttgctgagaagagaactgtattgggaaagctctagaagtgtttgatacatacataaacaaggcatggtttttgcacttaatttcacattacatttttcccagaaaaaaaggaatgtataggcatcacgtaactgtactagctggagtcattcttcctgattatcaaaggtaaacagttattaatcctataccaagatgtcaaggagaagtacttttggaacacaaggaattctctgggagtccttactactctcaagcccagtgaaaaagttaatgaaaaactatagtaccttcctataagctggatgactaattaccaggctcatttaggaatttgccttaccaagtaaaacataagggcagctgaggtgctgactgaagacaaatggagcatagaataagagtagtaaagaatgccaaaaatgctgtcatgtatccattgacaaaaggagctataaagcctttaggtattttcacacttgctctgttacgtaaatgtatgtgtgtgtgtgtgtgtgtgtgtgtgtgtgtg

SEQ ID NO: 2 - DNA, 237326 bp; single-stranded, linear
cacacacacacacacacacacacacacacacacaaatgaggtatataaagggtctcctaaaatgtcatctgatatttgttatttcatattctcagatttttaatccatttaggtaggtctattttagatagccttgtctgaaacagagctgggacctgatgagtgaaaatgagctcaccagaagaaaaatcaaacaggcatttcagagattgaggccaagaagttaaatgtcttaaatgggcagagcttagctgcttgatgtgaaaagagaccagcgtggctggaacagcaaaggagaacagcagaagaggtgaacagaggccagagatggtcactgagtgggcccttaagtcatggtaaggagtatggagaatgaattattgcatgtattgaatatgtaggtgacgtgactcacagatactttggatttgtagagatgaaggaaatgtagcaagtgacactcttagaatgttgatttgagtaaatggtagtgtcagttattgaactggggagaactggaagggataacaggcttaaggagcacgtttattcctgtgtcttggaagtgtttagggtgaaagacctattagagttctaaatggagatgtcaagtgaaaatgtggctacacacatttgcatttcagaaaaaaggtcaggctggagatgtaaaattggaagtttactgcatatagatagtctttggaaccgtagtattgatgaagccattaatgagacagaacaaagactagggaccagagccaagctccaagtttctaaaatttagaggatagtatagtctggtcattttgaggtgaatacttaataacagaacaatttgctgaagtgtaaatttagagccctacacttttagctctgactattaacgaatacaggaaagaatggatatggttatctgcctggtgtctgtgaaataatttaagccaggaagagatcctcaccagaaactgactatgctggcaacttggatcttagatttccagcctgcagaattgttagaaaataaatgtctatcgtttaagccaccagtctgtagtattttgttatggcagtccaagctgactaagttttggtacccaggcgtgggatgctgcaacaacaaatacctaaacatggggaagtggctttggaaattggtgatgggtaaaggctggaagagtttgaggttcatactagaaaaagccaattgtgaagggactattgaaagaaatatggacattaaaggcaattctggcaaaggctcagaaaggaagagagctggacagaaagcttccattttcatagaaacttagatttataacgatcatggatagaatattaaatatgctggttaaaatatggactttaggccaggcgtggtggctcacgcctgtaatctcagcactttgggaggctgagggcacagatcacgaggtcgggagtttgagaccagcctggccaatatggcgaaaccctgtctctactaaaaatacaaaaattagctgggcatggtgatgtgcttctgtggtcccagctactcgggaggctgaggctgaagaatcgcttaaacccggggggtggaggttgcagtgacccaagatcacaccactgcactccagcctgggatacagagcaggactccactccccccgccacacacacacaaaaaatatatatatatggacattaaagtcaactcttgtgaggtctcagatgaaaatgagggacaggttattggaaactgtagaaatcactgttcttgttacaatgtgtcaagaacttggctgaattacgctgtagtgtttactggaaagaacttataagcagtaaaactggatatttaccagaagagatgtctaagcaaagtattgaaggtgtgatttaggtcctccttactgcttaaagtgaaatgtgagaggaaagagccgaaataaagaaggaatttttaagcaaaacacaatcagaacttggagatttgggatagatttctcaatctatattgtaaaaattgagaaagtttttcttgaagaggtatggttgaacaatgttttctttttctttttttttcttggttttatttttatttttatgttttttgagacagggtctggctatgtcatccaggctggagtgcagtggcacaatctcagttcagtgcaacctttgccttcaggctcaagcaatcctcccacctcagcctcctaagtagctgggactacatgtatgcaccaccacaccctggctaattttttgttgttgtttatagagatggggttttgacatgttgcctaggctggtctctaactcctgagctcaagtgatctgccctcctcagtctcccaaagtgttgggattacaggcgtgaaacactgagcctagcctgaacaaccatttgataaagagataatgggtgtgacccaaggatttaatcagccatctcagcagaagccaggaagagagatgggattattccagcagagacactgccaatttaaactaacgtaggcagagaaaacagaaaggaacaaaggaaggttgtcgactttttgaattctatagaacaggatcatagagctacctggctgtcaatgtgtactattctttaagaaaaggaaagactgacccaccaaaggcaacttacaagatcactagggctgactcttttttgttttttcttgaggcagtctcactgtcacccaggctgtagggcaatggtgtgatctcagctcactgcaatctccacctcccaggttcaagggattctcttgccttagactcccaagtagctgggattacaggctctaaatctgtaccctcccgagtagcgctcctgccaccacttgcccagctaatttttgtatttttagtagagatggggtttcactatgttggccaggctagtttggaactcctgacctccagtgatccattctcattggcctcccaaagtgctgggattacaggcaggagccgccagggctgccactttgatgtcagactcagagagtacagatgggatagggtgggggtgggaacatgtagtcaaggctgactctacctgtttcaaagatgccctgcagaactgtgtgggagtctctcacagatggctgcctgggtgggaccccaccaaactgaaagaccgagacttcaggcagggcagatggagtaggccaactacagagccagaggtgacactgagacaccactgggcctggaaatcagggcatcaagccaaagagggtttttcttaagacctaacagaatttgccttgccaggttttggacttgattaggacacattacaccttccttctttcctatttctccattttctaatgggaatgtctattatgcctgtttcaccattgtaccttagaagcatgtaacatttctggtttcacacgttcaaagctggaaaggaattttgtctctggatgaatcacacattgagcctcacccgtaacctgatttagatgattttttagatgacactttgaactttagaattgatgctagaatgagttaagactttcagggggctgttgggatggaataattttttttttttttttgagacggagtctagctctgtcgcccaggctggagtgcagtggcaccatcttggctcactgcaagctctgcctcccgggtttatgccattctcatgtctcagcctccagagtagctgggactacaggcgcccgccaccacgcctggctaattttttttttattttagtagagatggggtttcaccgtgttagccagaacggtctcgatctcttgaccttctgatccgcctgccttggcttcccaaagtgctgggattacaggtgtgagccaccatgcccggctgggatggaataaatttatcttgtatgggagaaggacatacattttggcaggtcaaggacagaatgttatggactaaactgtgtcccccaaaattcatttattaaaaccctaaaccccagtgtgactgcatttggacatagagcctttagggggtacataaaactaaagatcacaggatagggccctaatcccattggggctggtgtccttacagaagatgagacacttagagctctctctccacgcaggcaccaaggaaacaccatacaaacacacagtgagatggcagccatctgttagccaggaacagattctcaccataaactatgttggcaccttgatcttaaacttccaggctccaaaactgtgagaaaatgaatttctgttccaagcctcttagatatggaaaaaaagattctgttgtttaagccatccagtctctggtattttgttatggcagcctgagtaggctaagacaatgaaggatgtggtaaaactttacgtcccaaccacataccaaagaggctggaatttagcatgctttcttctttcaactgtaggcaatgtgcacaagttctaaatcctaagacatgttggctcctttactctgcccaaactacaactcaaacaaacaactgtaatataataacatccaatgaagttctgacatttcttcaacatgagtacagtaattcaatgccagagaattcattttattttgaaatctacatgccatattccaatttctgttgaagatgcaatggttatatttattctttttaatatagatttatcagactgggcgcggtggctcatacctgtaatcctagcatttgagaggctgaggtgggcatatcacctgaggtcaggagtttgagaccaggctggccaacatggtgaaaccctgtctctactataaatataaaaattagctgggtgtggtggtgcatgcctgtagtcccagttactagggaggctgaggtagaattgcttgaacctgggagcaggaggttgcaatgagtggaaatcgcaccagtacactccagcctggatgacagagcaaaataataaatacataaaatagatttatcagtttatcaataatatagttttcttttctaggtgtaaatataggtaatgactgtcctttagtacattttctcatgatgctcctcttacttggtttggtacaatattaagtattgaaataaaatagagaatcctgtcgctacacatgagcacttattccatttgctcatctccaatatgcacgggaaattctcaaattgctaataatcttgtaacacacatgcattatattcaacaggaatatataaatttataattataatttaggatcaacagatgacaaacctttagaaggtttgtatttaaccttaaaatataattttttaaaaattggttataaaatttctaatactttcttttttgtgacctcaaggggaaaatataattcttataaaagttcaaatgatttacagaatacaaaaagtgaatagagatgatgaatgaattaaaggaaaggatattgctacatagatttggaaatttaaaaagggaaattacgattgttgattttgtgttaaactgatctgctttgttcaagataccttatgtaccaaaaaatgattttatctcagcctcatatctcagtaaattcctgagacaaactttagtccctggtgcccaggtgcctttggtaattgggagacctctaggtttagcatcctcatccactcgccccaatttaaatagtcctccccagggccattcaggcaagggagatgaaaacttgctcaagagttggaatccaattgaagctaccgaaattcattgctcaatagataattttccctggaagtaactagggcttttgaatataatagtgggcatttcaaagtagaaggtaaagtattttggagatgaggagacaggacagagctacgaggaatgtcctttgctcagggactaggctcttagcagtacctcttaggtaagaactggttaactggcaccttctgtgtttctctgaagctccctttgcttagggactaggctcttagcagtacctcttaggtaagaactggttaactgacaccttctatgtgtctgaagctcccagaacaaactgccaatgaaatttggatttttggaatatagtttcttttttgttgttactttttgttttgttgtttttttttgagagtctcactctcactgcaacctccccctcctatattcaagtgattctcttgcctcagcctcccgagtagctgggactacaggcgtgcactagcatgcccagctaatttttgtattttttagtagagatggggttggtttttttttgagacagagtttcactttgtcgcccaggctggagtgcagtggcacgatcttggctcactacaacctccacctcccggggttcaagtgattcttctgcctcagtctcctgagtagctgggactacaggcgcctacaggtgaacaccgccacacctgactaatttgtgtagttttattagagatggggtttcgccatgttggccaggctggtctcaaactcctgacctcaggtgatctacccacctcagcctccccaagtgctgggattacagatgtgagacaccagatcagcctcagaagacattttctattggaaagagaaaacactattagcaacctattagtctaatatttaatacttaatgtcttccttagtaataaaccaactctctacaacaaagtgcttcctggctgcctagtcattgattcattcagttcaacattttctcaatgcccaacagccaagtgtctcctgtatgccaagttctatgctgattatcagtatttgaataagagggggtctacatcttaagtactgcttaagatgaaagcctctaggttaacaaacttaacacaatgtatcattcactactaaatagaccgaatacaaaatcttgttattggagcccagagagaagaattgaaattcaagttttctctctctccttttctcactcaccacaataagtcagttgcaccaagtcttgtagctctttactgagccatgttttcacgtgtccctttgttttatttgccacaccctaaataaaaattgtactggctttttttccctgggtttacagtattaatacattgtcaagatttacctcttcgtgtagattccctggggaaaattacctttcctccttcccttaaattcttcagaggttagaaagccattagtaacattctggtatgtggacaaagtttacccattatgtatggatgttttactctttccatttttctgacaataatctcttaaggaggtgtggttatagaatagtcagctgttataagtactgttttcctggccttacaacttaaattctttaagctgtttcttagtttgctcatctcaaaattcggaataaggataaaacctatctcttagattgttggattaaatgaattaacatactggaagctcatgaaatgtgcctggcacacagtagtgcctaataaaccatctctcttattcagcctgttttctgatttcagaatctacacttgctgagccaggttcttttcatttcaaggtgagcaaaagcatacaaggaagagatggaggtaggaagagattaagccctaggccaagggagctggaatcaaaggcaatttggtcagtgaataaaaaggattccaaggcccataaggcaattctaaccttaggatcgaaattctcggacatacaggaaatgctgggggggggaaaatccggtcttctcagcccaagagccatgtgaaaccagaccttcaaatctgatgattctcagcccagctgcccattagaatcgttgtaatttaaaaataccctcggaaaattctaatatgtggctatcaaaggtgatcatttgcttttatgccactttgttttcacccaaatgggacatccaacccttttcctttgagagtagttgtagggaaaggagggggtggagggagggaagagcggaaaaggctggatccgccccgagccggtgtcagtatctgggaagtgggaggcgcgtcagcagtaaacagcttctgctaggattattatctcctgccacacactcggatttgaaggctccaaacgaaacaatgcaaaacgcttcagtggagttccagaagcgttagactaaacgactgggtctgtttggccagtctgagcagctgggcgcagatgcataggcaagacttagcccgcctagacttttctgcccacttaattccgatcaaagcagaaaccggccgggcgcggtggctcacgcctgtaatcccagcactttggtaggcagaggctggcggatcacctgaggtcaggagttcgagaccagcccggctaacctggtgaaactccgtttctactggtggcgggcgcttgtaatcccatctactagggaggctgaggccggagagtcgtctgaacccgggaggcggagtttgtatgcagtgagccgagatcgcgccactgcattccagcttgggcaacaggagcaaaactccgtttcaaaaaagcaagcaaacaaacaaaaaaatgcagaaaccgagatccggaagaaaacctcggcgagattcacagaatccaggaaaataggtctctagaaatttgtccatggtcccagatctccatttcttgtgggtggggcagctgttaccagatccctagaagcaaaggtttttttgggggaccgtgtctcactgttgcccaggctggagggcagtggcacgatctcggcttactacaacctccgcctcccaggctcaagcgactctcctgcgtcagcttcaagagtagctgggagtacaaggtatgtgccaccacgcccaacttatttttttatttattatttttatttagtagagaggtgtttcaccatgttggccaggttagtgtcgaagtcgtgacctcaggtgatcagccccctcggcctcccaaagtggtaggattagaggggtgagcagaaagcaaaggtttttgagtggccacaggccccactctatttccttttctgcctgtaatggcaacctagacgcttgagcttcttaaaatacaagagtaagttgcatgtcaggcaccgttctacattagggacattagtctgttttacagacacctttcaactccctggttaacttttaggtaatatactctgcactttagcaggaatggaacctataactctcacagaattaggaaagtgaggctgcctacagcctaaattgagaaaaaaatagacgggggactagtcggaggaccaaacaaggttaccaacacgttagagttttgccttcaatttacatttttaaagtaatcacaacgaagtgtttagatcacgaggcatccctgcatgtaaactgttaggcactaactatggtcgatcttacaaagcattaactagaatatttctttagagtatgatagtacgtaactgacctactattacatacaaacagaccaacctttagtaacagcgctccccaaaaaccgaaaagcagtaatacgctttgctcaaggttggcataaaattaacttaccttagtgccttttttccttctacctacaagcagtgaggttagctcttcctttgaaacggtaggggggctctgaaaagagcctttgggtttgatagcgtttccgggagctcagatacctgtcaaatcacttgcccttggccttgtggtgactctcggtcttcttaggcagaagcacggcctggatgttaggaaggacgccgccctgagcaatggtcacccggcctagcagtttgttgagctcctcgtcgttgcggatggccagctgcaagtggcgcgggatgatgcgagtcttcttgttgtcgcgagccgcgttgccggccagctccaggatctcggcggtcagatactctaacaccgccgccaggtacaccggcgcgcctgccccaacccgctctgcgtagttgcctttacggagcaggcggtgcactcggcccaccgggaactggagaccagcgcgagaagagcgggatttcgctttggcgcgagctttgcctccttgcttaccacgtccagacattgcaatcagacaaaaatcaccaaaaccagcagcctaagctcacgagaaaacaaacaaaatcaagaaatatgtaaaacatggccgcttttataggtagttcctggggagtaaatccgactttttgattggtcggtagcaaatgctagtcagatagccaatagaaaagctgtactttcatacctcatttgcatagctctgcccacggatgacaactgtgtagtttgtcttccaattaactaagaggtactctccatccctcattagcataaaagccctataagtagcagaaatccgctctttactttcgacacatttctggtgttttaagatgcctgagccagccaagtctgctcccgccccgaagaagggctccaagaaggcagtgaccaaagcgcagaagaaagatggcaagaagcgcaagcgcagccgcaaggagagttactctgtgtacgtgtacaaggtgctgaaacaggtccatcccgacactggcatctcttccaaggccatgggcatcatgaattctttcgttaacgacatatttgagcgcatcgcgggcgaggcttcccgcctggcgcattacaacaagcgctcgaccatcacctccagggagatccagacggccgtgcgcctgctgcttcccggagagctggccaagcacgccgtgtcggagggcaccaaggccgtcaccaagtacaccagctccaagtaaacattccaagtaagcgtcttaacacctaaccccaaaggctcttttaagagccacccagatacccactaaaagagctgtggccagacgccaaattttatttggcggcggaggggtattagaatgtaggaactggagaggggtggggacaagtgttgcagcttagagagggacaaagggtcctgaacccgaaagaagccagccattaaaaatgggtttggggtcaattcgttgtgcttaaatttaaaatggggacaagcggccattttgctaactcggcgttcccggaagaaaccgcaggctcgcttaggtttcagacccagctgtctgtccctgtctacgtcgccaggatcaacggttgccgtaatgtcataatttcgccaccagcttctagccaataggctgtcctgtcattttaaatattaaccaatcgagggaaagctgttttgagactctgatttacatagcggaccggagtgggaacctgggcagtaactgcctaaggaaggactccccctctgttttcgtggcgcacaccttcgtagtatactgaagggtgtgtctcctgggtttccaactgccccggtaatagtcttttaacctaatatgcgtcagttttgataacaacactaaggcagtacagaactaaagatgtaagcactgcgccagatgttgcttcatacatcttattctattcaactggtttattcaagattcaaatcaaatcaaattttgcttgaatcccagtgctcagtcagccataaatggtgtgttgcctgattgaaacttaaaatctccgtagggggcttgtaacatgcagaaaagtttgaaagttgctttaggagaagccaactcttaactgctgggtaaattgacaagccttcgaacactgaactgaaggccagtaaggactaggcgctgggtgggggagaatgaagaggagacgtcattaaacttagcacatacactgtgtctcctagaggactctcccttcctagacaactgcaggccgctttgtggcctgggaaattccacattcccttaagtattttactcatggtcttttccaggtaaagattttaagatgaagggttagacgtagtctacctatctttttattcaagtctagaacacgtttttagcacctagaagtttgctttctccattaaaaaccgggaatatacaataaataaaattagtgttaaagcagatttttacaaacttaaataccatgtaatttaggttacagttacttaacataaggactgtgtgatcttaaatctgcaatttctttcacacctgggaaataaactaaggcctgtctttggtgccagacaaggccttatacttgaacactgctgtgcaatcacaggctgccttgcctagataacttatctgagaaattctgatgagaaatgaaatttccagagtccctcacaagtaaatttttttttctttttttttttttttgagacgaagtttctctcttgtttcccaggctggagtgcaatggcgcgatcttggctcacagcaacctccgcctcccgggttcaagccattctcctgcctcagcctccggagtagctgggattacaggcatgcgccacgacaccctggctaattttgtatttttagtagagacgaggtttctccatgtcggtcaggctggtctcgaactccggacatcaggtgatctgcccgccttggcctcccaaagtcctggattacaggcttgagccaccgcgccgggcctaaatggttttttttttttctatgcctctaatggacctggtcacttattcccattcagactgaccgctctcctacctgccaactaactaatcagtgtaaccaaaatctgcaaacaaaattcagtattctttccccgccttttcccctttctcttacatagattatgtttttgcctgtgttagatgaaataattctattgcttgttctctcttctgtacaagtacccagtaagcaaattattaacttcttggtcatttatttctgaattttccaccaagacagtgtttatgtgagtcatacaataagaaccaacagaaatgtgtgtcttggaaacaggttgtctatccctggaccctttgagttttctgttcactttcctttggcttttgcatgctaaaagtttatcgtccgcgtttgtttgttttggttattctaattggacttggctgattggttgcatattggtggcagtagtagaatttgaattctggttttctggtcacatcattaagtgattagtcagtggagaggacaggaaatctggtttatttattaacctttttttggggtgtttttgtttgaagatgttgatattctctgtgaggacacagggttagagttggtgtttttctttctgactttacatgggatttgatgttttgtgcttgtatgcctctttccaccttccaaaacttgtcttttttgagtccaaatagttgtcgatatctgcaaaaccagtattcctgtgttaagatgatatgaatataaaatggctgccctgttataacttttgactttaagaaagtgttaggactaacaggagacaaaaaggaaatcaaggaaaccaaatgtctggtctcaataactgctatggcagaggctctacagcttattattaattttagtaatttcacattattgccccttcacgttctttaagtaaggttagaggacagaagaaacataatgttgttacaaattggactattgagtcaggaaaaaaaaagagtgctttcaatatctgaataaaacaaagatttaatattttctaaaccttaacgagtttattgtaagggatgtgatgctggaaactaggaaactagaattttcttctaaactgagaatcagaattattcatattctcagcagtggtgccacctgagggacttctgatcttaattacatacttttatttctttaactgatcaacatgctaaatagataacctatggctctgtttttacccactttaaattctgttctattagcacggttagctttcctaattggcaataagattgagactatcttttttttttttttgagacagaattttgctctgtggcccaggctggggtgcagtggcacaatctcggctcactgcaacctctgcctccagggttctagcaattttcctgcctcagcctccccagtagctgggattacaggtgcaccaccacgcctggctaatttgtgcatttttagtagagatggggtttcgccatgttggccaaactggtctcgaactcaggtgatccacctcggcctcccaaagtgatgagattacaggcgtgagccaccgtgcccagaaaagactatcttattttatgaatttaaataattgtgaaattatccacttaagggaattaataaattataatgtaatcttaaattttagttggcttacataaagacttaaaatacatcaatttaaataaaaactcatttgtctaaaaaaaaatcaaaaattttccttgtgctttaaatgtgctacctctttaagttctaattaagagaaaaaaagtttaactgtgagtttcattagtggtcttagttaacagcttaaagtattttgtaaaaaaaatacttcacaatttttaaataacttaaaaatattaatacctcttttattaggtttttttaataaggaaaatatataatacatctaatcaagattattttttggacaaattggcttaataatttcattttaaaaatggcttctttattcttatactgtaaaaataatattagcagaatattatagtatacacaagtttagggttcatattctaaaaaacaaaaacaaaagctaatttaacttgcatttactaaatttcttccactagttgtactggttacatgagttaacatcactttatttattattctaaaattgtaaattattcattgaaccaaattaaatgataatagataatgtcatttttaaaaatggaattaaattttatgttactaattataaggattcaatgtgtgagcttaagtactgagttcacagtgtatgataactttaagaatttaggtgaatattattaaattgagtaaattaattctcaatctttggatacctggacaatttctaaattggagggtacaaaatacaaatcacaagaaacagtgtagttttatgcaaataacatttttacacagtttagaataaccattgataaacagataagagaacatatgattgccttagaatagatactgttgctttcgccactttagatttgtaaatcatgtactgtatacgtgtgggcgtagaggaccatgcaggttttggatgactgcctctgttttcgtcatgcctatgcgggaacacaattgcctgctttgtttaagggctatggttaatccaaacagctctgactctatcaagtactatagctacagagaaacacaagtaagcattcgagataatgactaccttgagcctttacttatttaaaaagttgttactgtttgttaatgtggtacattcaatttactatggattgtcactctaaaataagacttcaatctttttcttatttttatatagccatgatttatattcatatcttaatgtaataaccaatcttctctgacaacattataacaatgctggaacctccattttcagtacttcaaacaacaaatactgcttttatacttcagagcagatggatatgtgcttcccagtgtaaacacatttggaatctcactgagaaatacactatcactaaaaatacagttctgagattcattaaaagacctccagaattctggaagtaggaagtttcctcttcaaagtctacagaggaagacgaggtctgaaatagacagcttcttccttcttttacctgtggtattattctgttttgtccttttctccattatctgtctttccagtgatgaaattttgatctggccctcccaagtattaaaaaacaagcaaataaacaaatctcagttatattttactaagatattggcatgctaactttttgcaggtttgtaacaaggacctttataacttgactaaaagttcctaaataagaatatttactagaaaatttatttctgcctgtggcccacatttgagtcaaaataatcaattaggaaaaatgaacttgtttaactaaagttggccaaactgatctttgagacctattcatctaagacaagccaattaaattcttggagacaatttgtactttaaggaattcttataatatttgtaattaccctcataactttttttttgccctacttctgtgcttctctaatatgcagattattaaatgttgttacaaagccattgtcaaaaaaacaaaaaacaaaaaactaaacaaactcacatggttagacttgctcctttatgagatatttttaccaaaaatggaggagttgaaaaactctggtgccagaaatcgtgaagacatggcctacctaacttggaaatgttggttgtcagtggaaaatactacacagagatagccatagtgctgcacagccaatcttaagtgtttctagagaatcactaattgtttctagagaatcactaattgttttcttttaacattcttggtttatacaagaagagagtatccatactaaactcttttctactgaaaataatgtgcaaacataacatcctattcctagacagtttgtagtttttttctcccatttctattttataaatcatctttttaaaatactttgttgagtgaaatcagtccattgcttgatataccttgagcacaagtaaatagtatgccaaaaattaaatgtctttcagtcacagtttgacaaactcaactaccctgagcctatagagtggtaataattgccctactcataaagatggggtgaagattaaatgaaatagcacctatagaacactagttccagacgtggtatcatgctagtaaaatggctgcacagcactgctcaatgatgacaaaaagtgaagcttctggagacagactccaagtttgactcccagatcaccacatataagatgtgggactctgaggcaggtcatttaatctctctgtgcattagtatccttctctatacctttacagtgatggtaatagcacctaccttctagaagtatgtgaagattaaagatccttaatgcatataaaccactgtgtttactgctgtttgacaaattttatttataaccatctttacgctcctaaaaggacttgaagcagcttatgactgaagactttggtaggagttggccttctataaattataagaatttcataaattatttgatatgaaaatgccagttgatcatagtatgtttaccggggtccaacaggttgagaaaaaatacactttttttccctgaacatatgaaattagctctctaggcatattcctaaggacttaaagaatgataactatcatttctcttaaatcttccagatttggaaggatatatatattcagcacattgacagacaatcccagtagtcctaaattaaaagacattaaaaattagtgaaacttttcctacctttagcctgtgtaatcctggatgaccaagcataaaattaaattgagtagagtataccactgtaacatttcctgaaaggtattctaggctctgagtaatttctttggggtctgaagatcagtttgacatatcctcaagtatcatgagttcattataattaagaaaaagggagtaaatctggagaatgagccactttcttactactccttgacctcagttctttttttcagagacagggtctcactttgttgcccaggctgccaggctggagtgtagtggcgcaatcgcatctcattgtaacctccaccttctgggctgaagccatcctcctgcctcagcatcctgagtatctggaaccacagcaggtgcacaccaccatgccaagctaattttttaaaaagttttttgtagagatggggtcttactatgttgcccaggctggtctcaaactcctgggcttaagtgatcctcctgcctcagcctcccaaattgttgggattactagtgtgagtcactgtaccccgccccacttcagttctgaggaggaaaaaatatgtaataataatgggactttggtttgctgatttaaagattcatgtaaccttatcatccaatgcgcaatttgtagaataattaatagagacatctggtctcatgtttctacagttgctcatgccttgatagtagatctccttgctgctggctcagaagggtaaaagagcagaaatgatggggcttctctcattctatgaggaaatagacctatgtagaggaggctacctgtggtaaaaccttatcctcatcacttaaaattctaggcttattctctgaccatatcaagttttcaaatggtaaaagaattggattcaagagaaatatgaataaacttttgttttcacttttctccctcctctccccccattctcccttcctttattttcttgtccttagttttcttttcacttttttgtctactattatttgcccaaactcaactgtaggctagaacaaaaaaaaattgaaaattaaaatgtgccccttttgttgttagacttgcttaaacaattggggtaatgaaccttggacactagattttaaaacacacacatttgagcttcagtgcactgaaataaatatatttttaacaattaaaaaataaaattgcatgtttaaaaaatctgcagagaacaatacacgttgtgagatcttgaatggaaggaaaactgctagcctcaagagtggatcaaagatgctcagcaggcaacagagtaagagcatgttggagggtttagagagtgtgctcagggttctaggctctaaaaatcagacagtccccacggcctggccttcgtcgctgtatcttctttatgaaaaacactaagtctttttcctcactggataaatttttatccttcaagtttagatcaaatggaactttaggacactgactaggttacattcatcttttaagagcgtacagacattcaagggctagaggatgtgggtttactgcacaggctcattatccaacagctgtgctacctgggaaacttaacctctctgtgccttaatttcctcatctataacgcagggagaatgacagtaggtatctcataaggttgttggaacaactaaatgcattggtatctattgtgtaaagtgcttaaaacactgcctggcacagagcaaacatccagtgaactttagccatcatcattatcattgttctcagagtcaaatacaatatctcatatctgataaattacagaagtgaatcaatcactctctctcttttctccagggggagacaacagcttttagacatatcttttccaacagtcgtcactgctggacactgtttcatcttgcaaataaaccaatgaaaatgagtgatcctagaagaagataaatggaggtattttgaacaatcaaagaaggacaaatgaacacctggctgagaaaaattagctcttttttctatgcataaaactattaaaatattcttcatagaaatttatgacacaggaaacataaagacaaaattaaaataactcctagtatctcctattctttttatatgtatattatatatactcatattcatatatacatatatctcacatcatgtatcatatataaaataaatttaggtgtcatgatatatatttagataaatatacttagaaacttttttatggatgtataatttatggatatattgataattatgtatttgttattgactacttcaattgattcccatttttatgcattatattatagattatatagctcacacatctttgtacataaatctttgttcaaatattatttcctaaggatagacttcatgaagtggaaatactaaatcaaaagtgaaaaacattttctaaggttcttaacatatacattgccaaattgctattcaggatcataccaatttataatcccaaaataatatgaaaattcctgttttatagcactcatatttacaataaattttaaaaatcactgttaacctaatagtccttcaaaagaaaaaaaaattgaaattacattattttaatgactctattagtgagggtcattcttcccatgtttcttgttagccatgaccctataagaaataaactgcactgcaaaatgataaacatgatatcaatcattacatgggaaggcactatataaagaataataccttaggttaaggccacataaatatttatcaggtgccttttctgcggaggactctgaagggatactaaactgcatttagctgcatgcaactgaaattacttttacctacattgtctcttataaacattataactactctttgagaaagtgtttactatggactgaattgtctccccatccccccaaattcatatattgaagccataaaccccaatatgactctattcctagacaggacttataagaggtaattaaggttaaatgaggtcattaggatgggttcctaactggataggattggtggccttataagaagaggaagattctgcacttggtcttccaaattaaataatttatttaaaagaaaaaaaaaaaaagaggaagagagggagctctgcacatatactgaggaaaggctatgtgagctctcacagtgagaaggtagcactctacaagccagcaagagagccctcaccagaatccagccatgctataccctgctctgagacttccagcctccagaactgtgataaaattttgttgtttaaaccacacaatctatggtatttttttatggcagcccaagccaacaaagacagcatcattgctgtcacttacagacaagaaaactaagactaggagagagaaaagttaaacttgtccaaggtcacaaaagccagaaacaagtgaggtgagaagttgaccttgttctcctcaatccaaggccaggactcctccactccacatgtagatagccacctcacagtcaacagccaaatgtccacaccccagagtcagcattagaccaagatgtcttaccaggagacaaatgcctcatcttgaataaatatgttctaacaacttacccatgtaaaacattgaatctcatgagaaacaaaaatgcaaagtatgtagaaaactatgtttaccacttaactgacagtgataaaaagcttaatgatatccttatagtcttggaggggtttgtatatgtggtgaaacaggtgctcacgcactgctgatagactgtaaattggtcctagagagaaaaataaataaactggaaggagttatgctgtatgtttactttttttatggaaacatatgatatacctggaaattcgattggccatgcatctatttcttcaatgggtatgcacagttgagctgttcccatgcaccaggcactgtaatgggacaactgcacatgacagtcaaaaatctcagtctcatgaagtcgacatgctcatggagaggtgctacccactaaactaatatttgtatatcaattatggatacattgggccacatttacagaaattcacttacagtgggttaccagaagggattttttttcttgattggcaagaaggctaggctgttttgttgggggctggcaggagctgtctaggctgcccaagtatgcaggtctcttctatcatcctgtgttaaccatcttccatgtatctttcaacctcatggtcatctgcagcatgtctaggggtcatatctatgttccatgcaggaaaaaagggtaaagggaaagggaagtaggcatgtaccattttaatgcacaccttggttttcagaaaatttaagaagaaagactttctgcttttctctgactattctgtattctggattacaacgcaacagaaacgtcaccttaaattctaatgtttttctctccttgctttcaaaaactgactcattaacctccacgtggcttggaaaaattatttcagtcatccagtaatgagctgttcatagaaatgttttggacatcaagtctgtgttgttagcattatacatgttaagcattgaataaaaaacaacatgatgtgggtacatttctttacttacatataagtacttatatacttatagctgaaaagagaggttgaaatgtcaggtggaacagaaataagattacctagatgtttctcctatgggtgattttcagctatgctgatctttcttctgggtcaggtactcccagaacttcctaattaaatggtggccctgatcttagttcctctctcctcttagacattttccaggactacagaagatgtgcagtttataaatgagtagcagaaacctactgaacaaattattcaggctcatctgaacagagaggacaccttctctgctatactctctcagtgatttccctgccttggggtcaattattgtcttggacattgatttaagcacataataattgttgtcattgcttatgtttggatttcatctcccaaaatagatggtaaattctttagtttagagaccaagtaatacttacaaaaaaattttgtgtgtgtgtgtgtgttttttctgtgtctctcagccctgtaatagcatcgtacttacacttgttagatttttagagacaacttttacaaaacatggaattatctacataccctttctacaaaacagacaaattaaatactcagtagttgaaccaaaaaaagcagttcaaataaaatacttgaaaatgaagaaatcatttgaacagagttaaagttaatcgtaaaataatgtctgtaaaaattattgccaatcaaatataaagttcaaaaatagtgcttgaaaaaggaagaatcatatgaaaagggactactcattttaaaaatgttagatatcaggaaaagccaagaagtgagtatggtaagagtgctgtcaagtgaaaccctgctaatctcactgaacatgtaaaaatctgtagatgcctttattttattcactcacacacatatgtagaaagagaaatatatggtaaacattaaaaaaaacaaattagaatgtaaaattaatactttaaaaaatgggctgtatacttttcttatcaccggagataagaatttattatttttaaaataaagttattttctctgtgactgtttccatgactttgctacttagaagttagagatgccaaagtttatctaagaaaatgtttatggaaatattatttcaataatgaatgtttagaagactgaatttcctgactgggcacagtggctcatgcctgtaatcccagcactttgagaggctgaagaaggaggatcgcttgagtccgggagttcaagagcatcctgggcaacacagcgagaccctgcagcaaagtaaaaagaaaaaagaattgaaaaaggaagactgaatttcctttgggcaagtcatgtgacattcctgtgcctcagtttcttcatctataaagttaattcctacatttttggggaagggagagaaaaacttaggatagtgactggcacagaagaagcactatatactatatatatgtggatatcatttgtttttatggtaccattttagctatctaatgcaaaatatgaatcttttttttctgggtcttaaattatggaatgtaagaattttctaaattctctaattctgtgttagttttaaagcaatggagtaacgtatctgtcaacttgtaaatataaggatcaacctgatccacaatttgacccctagccactaatatttaatagtacaacactcagaaattatcaaaggtcagagaagccaaacaaatgtaaaaacatacaggtgctcagaaagatgcacctgtaatctctctaaggagaaatattttccaaactgagtgacacggtgctttagtgagttgtggaatcaatctcatgatttccaacctagtgttcttttaaaaatgaactagtccacagtagaatatactaaagtgctggtgcttaagatagtattgttttctggaaaaaaaaaaaaaattttttttttttgagacagggtctcgctcttgcccaggctgaagtgcagtggcacaatcatgctcactgcagccttgacctcctgggcccaagtgattctcccacctcagccttttgagtaactgggaccacaggtacgtgccaccacacccgggtaattttttaattgtagagacagggtcttgctatgtgcttaggctggccttgtgaactcctgggctctagtgatccactagcctcagcctcccaaatttatgggattataggcatgagccaccctacctggcctgttccctgaatttttttttctttcaggtgtttgtgcatatgtgtgtgtgtatgggtataacagagagacagagagaaagaaacttttctatcacactttgcaatcagaagtttgaagtcttatcttttggcttttgtttcagaaatatttcaaatgtagactctctcctttaccacactgtccccttaggcaaggtctttgccattcttctgagactattgcaacagactcccaacttctgactgtgggcccttctcaaaaatgattgtttatgcaataaatctaaacccaagacaactacaacaatacaacaaattctctgcttaaaaacttccaatgtctgccgggcgcggcggctcacgcatgtattcccagcactttggaggcagaggcgggcagatcacttgaggtggggagttcgagactagcctggccaacatgatgaaaccccatctctactaaaaatacaaaaaattagccaggcatggtggtgggcgcctataatcccagctaattgggaggctgaggcaggagaattgcctgaacctgggaggtggaggttgcactgagccaagatcacaccattgcactccagcctgggcaacaagagcaaaactctgtctcaaaccaaaccaaaacaaaacttctaatatctaccaaatgtttcacacaagtatttggggatcttcacaaatggcccttatggagttttcctttgctgagaccctatgctctggccacactaaactcattcagcatcccagaaaggcctcagcctttgtgagcaagctcttatctccaggcctctcacaaagacctgttccagtagaagctcaggggagcacactggacattattccaacaaccctttccccacagctatgcagccaaatctgccagctcagttaattaattaagcaattcagagatgagggtctgcccaggctggagtgcagtagctgcgacctcaagctcctgggctctaagtgatcctcttcagtctacccagaagctgggactgcaggcatgtgccaccacacccagctaatttttttttttttcagtagggaccaggccaacctagtcttgaactcctggcctccagccttccgaagtgctgtaattacaggcatgaatcactgcgcccagccaacccgcccagtcttgttagacatggggtctgtagtttctagtaggttcttgagtctagggttcctacctcatgttttatagttaatttaggggagggactgtgtctgtttatctggggatgtaggggtgggcagggggatagaggggacttcaattaatgaaaccagaagcaaaactcagttgaggacaccggtcatgagagtggcctgattatggccaatcttacataatgtgtgagatcttgatattaccccatccttgagagtcctctataaagctacagggacttgggagcacctttaattacagacaacccatgttcctgtggattatgatttattagattgcacatgcctaaataaagacatcctctgcagtcttttgacaattctataagcatcttctgactccgcaattagacagctaagagatctgtgttacttccctcacatatataaataattttaaataaaaatcatggcgtgaataatttctttcctctaccgatttgaagctatccatttggaagaccactctgaagagatgaaataagtcttctgccaaagattacttattaatttacaaggaaaaggggaagttttgttcctctccgtgaatttgattgaaaatcgagggctttctcgaatagttttggcatccagggtcatttttcattaaaaagagaaaagtcatgtcaaatatgaatttccgcagattattcagcactagaccctgggagattctgtaaagaggggttttgttatactcaacttttccgggtaaaacaaacacaaatactcctcctccaaggggcgggggcggtgcctaggtgatgcaccaatcacagcgcgccctaccctatataaggccccgaggccgcccgggtgtttcatgcttttcgctggttattacatcttgcgtttctctgttgttatgtctgaaaccgtgcctgcagcttctgccagtgctggtctagccgctatggagaaacttccaaccaagaagcgagggaggaagccggctggcttgataagtgcaagtcgcaaagtgccgaacctctctgtgtccaagttgatcaccgaggccctttcagtgtcacaggaacgagtaggtatgtctttggttgcgctcaagaaggcattggccgctgctggctacgacgtagagaagaataacagccgcatcaaactgtccctcaagagcttagtgaacaagggaatcctggtgcaaaccaggggtactggtgcttccggttcctttaagcttagtaagaaggtgattcctaaatctaccagaagcaaggctaaaaagtcagtttctgccaagaccaagaagctggttttatccagggactccaagtcaccaaagactgctaaaaccaataagagagccaagaagccgagagcgacaactcctaaaactgttaggagcgggagaaaggctaaaggagccaagggtaagcaaaagcagaagagcccagtgaaggcaagggcttcgaagtcaaaattgacccaacatcatgaagttaatgttagaaaggccacatctaagaagtaaagagctttccgggaggccaatttggaaagaacccaaaggctcttttaagagccacccacattattttaagatggcgtaacactggaaacaagtttctgtgacagttatctataggtttaagttgtgatgcagctgagttgaaaaggcttgagattggagaattaattcaggccaggcttcaagaccatcctgggcaacatagccagactaccatctataccaggggtcctcattcccccggccaccgaccggtaaccggtccctgtccatggcacgttatgaattgagccgcacagctgaggggtgagcgaacattaaccaactgagctccaccgcctgtcaggttagctgcagcattagatagattctcataagctcaaactgtattgtgaatggcacatgcaagggatctaggtttcaggctccttgtgacaatctaatgcctgatgatctgaggttggagcagttttagtccggaaatcattgctcccagcccctgcaccccctggtccgtggtataattgtcttacacaaaacggtctcttgtgtcaaaaaggttggagactactggttttacaaaaaagtaaattagtcaagcatggttggcacgctcccttagtccctgcacccaggcgtttaaggatacagtgagctatgatggtgctacctcactccagcctgggtgacagcgagtcagacgttgtctcaaaacttaaaaaaaaaaaaagttaaaacagaaaaagggcttcttgtcagagactgccgtatatctagaggtccaggaactaaaaagtctgatgtccaatcctgaaaagctcgatggtgcactagaggaggcttttacatgtaagagcatctaagttctggaaatgccagtgtcagggaagggaagtggagagcaatttggcatccaaacataacttgctgatactttttttttttttaacacaagtactacattctagtctttctgtggtgtcattgtaactattgtttcttaatatgctatccactgacttcaagggatcaataaataggaatcaaggtgtcccagaatatggattaggggagttttttttttgttgttgttgttgttgttttcatctattcattatcctgtagctgaaatttagaattttcttccattgtgtgtgactgatagaaataacaaatttgtaggttatagttgttgcaagaatctggaaatcgtgcttgcttatttccgaagtactattaggtatatcaacaaaaacacacatattacggtcaagtggtttgataattattttaatattattggtctaatacaattgtaaccctatgaattactttaagtatcttatttatgaaaagaatctgtaagtttcatcaaactaccagagcataccgaagactgaaaaattttaagaatccaaaccttaatggaaatgttggaggctgcccaattaggttctgaattccaccttcctgaatcacaaacttgttttaactctcagtctgaggtaaactacgtttctctttaaacagacatagtttaattttcctttgatttttgatttagtattcttactgatcatcataaataaccaatgctaatgttagtctactttggaccatggtatttcgagaaactttgaacaaagtcccctgcaaaactatgcattgcattatttcacatacatttatgttttccagacggttcaatagtacctcacttttctgaacttatttgtatagtttggcatctttttaaaaattgtgtcctataatgaaaggttgtaaacattatgttttaaatttgtatagataaaatcaaccacagacctttccttgcttggatgtaattgccattgtttcccaatgagttcggaattactaggattgtgcaaaaatatgcctcacttgcctgacatagcagagagccattttgcctaaatgctgtgcccagcaatggactgtcaccagattctcatcacatacagtgaggatgaacaactagcctctcccagcagctggccggtctctcaataatatgggactccctcaagatggcttcctgcacctttgctcctctagccttgtatgtatacaaggctagcatgcctggcatacataaggttaaaaacaaaatcaataagttatggttcttcctccagttctggggattattagaccacttttttgttttgttttgttttggatggagcctcgctctgtcacccaggctagagtgcagtggcacaatctcggttcactgcaacctctgcctcctgggttcaagcagttctctggctcagcctcccacgtagctgggattacaggtgcccgccaccacgcccagctaatttttgtatttttagtagacggggtttcaccatcttggccaggctggtcttgaacgccagacctcgtgatccacccaccttggcctaccaaactgctgggaatacaggcgtgagccaccgcgcccggacttagaccactttgttttggccaataggacaacagccatagaaccctccgcaaatgagagcttgtccctaaagatgctttatttacatagctgtgtgccgcatgagccaaaaggtgataacctttgttcaacacgcgcctccagcccttcggttaagtccaaagtaccattcttagaatgctctaaaatacataatttttttttttttttttttttttttgaggagtctctctctgtctcccaggctggaggggagtggcgcgatctcggctcactgcaatctctgcttccgggctagctgggcctacaggtgcagaccaccacgcccggctaagttttgtattttttttggtagagggggtttcaccattttggccaggctggtctcggattcttgatctcaagtgatacactagctttggcctcccaaagtgctgggattacagtcgtgagccactgcgcccagcaaaatgctttttgtggagccaatcactttattagcgcttacctctctatgcctactttatgctttgaaattttgtcacagtggggccggtcatggcaaacacaattcattcttatgcaggctgtcacggttatttctgtcatccaaactcattctcgcaacgcatttcagctctttaaacgactttgtgagcggccctgaaaagggcctttgggtttttttgtttttgttttttgaagttctcaggagaccgcgtattcttagattcagccgccgaagccatacagagtgcgcccctgacgtttcagggcatatactacatccatggctgtgacagttttgcgcttggcgtgctccgtataggtgacggcgtctcgaataacgttctctaagaaaaccttaagcacacctcgagtctcctcatagataagaccggaaatgcgcttgacgccaccgcgccgagccaaacggcggatagccggttttgtaatgccctggatgttatcccggagcaccttacgatggcgcttagcaccacccttccccaagccttttccgcctttgccgcgaccagacatgattcctatcgcagtggaaggtatgaactgaaacagttccttaaatacaaacttggcggacctgattgaaaacaacatgagttggcgcggttttttttttttttcaaatttggtcaccgagtgggtggagcaagaaaaactgtttcattatggttcattgttttgattggccagtgacagcttgctctttgtgggagtggaagggtgtttgcaagttgaatgcgctgtattcctgtcagcttaatgacgctaagcatagccccattccacatttctttttatttccacttgctaactaataaattacggaatagtttattggggaacatacaaataatgtttaaaggaggtcagatttataggtcaagggatttaccctcccaatcattttaatatttttatttaaaccaggcattttgatggccttctctgtgctggacaaggtataagtttggctatgaagtttcactcctaaagaccctatgttttgggaaggcaaaaaggtagccaaataattgcaaattaaaacctcataagtgcaaacttcttcctcgtcactttccctatctcgattcaaatatttgttgaatgactcatttttctgcaaaagtctgagagagacagggaatataaacttaagtctggataatatgttttcccgggacgctcttcctggtctgctgtgcctgtttgctgtgcctgaaattccaaacactcttcccttccctccgtttttaatcccctttcaacttgctacagctttagagaaaagaacatacgttttgtacagttggggattaattgaagtgtagggctaatacttgattaaggtcattacaaaatctacagggtcttcctctgggaggtttttgtgataagattattggtgttaaaataaggctaatccccttgaaaaataaatagaatagcagaattgggtctgaatgtggtttgaagaaagggacttctcaattcaaaattttattcttagcttcctgtgggagctttccagaatgcccataagatccacttttgtttaaaaaacaaaaacaaccccacccaccactctctggttaataaatgaatttctattgggaatatttagaatggggctgtggcctgtgagagacattatatagtaacctcagacttgctcacatgaagagaagaaatccaggaatggagaaaaaagacccaggaaaggccagaatgctctacatgtcatattgtttgtatcacttctgaaataattgattacattcttctgccccaaattgagttcttaggttcttccactcactgtccacatgccacaacacagaccttataactagagacttagctaggaagaaatgtcaaacattacagagaaaaaatgcagagtctgagatcataagtaaaactctgaaatctcaacatgccttttaattcatgaaaataaaaaatatagcagcatatgcaatatgataattctctgaaaacatacatcatgtgaactaccctggaacacatctcgccaagtgccatcttcattttaaccagaggtctaggatgcctttcctttattttgcctattatatcatttataaaaccccatttttattttgatattttatttactttctatttcctgctcctaatatctcctttctaaacttttctcaatgacagtgactcaaaaacaatgaatgtcagaacaaatatttaaaggatctgtacatgtagatatatatatttaaaatggattcttccactctgggaagaattcaggcatactcaatcttatggttagggagagattaggctcactcgcctaatctgtatggcttctcgttcgctttccatttcaccttcctctcacccatcagatcaaactcattcattgaacaagagacctaagcccttcagattaaaactctgcaaacaagttgtggttgagaggatacatgaagcattcaaacaaataaatctatgatattaatcagaggttaatctatgatattaatcagaggttaatgcagtggctcacggctgtaatcccagcacttcaggaggctgagttgggagaatcgcttgagctcaggagttcaagaccattttgggcaacatagcaagtcttcatctctacttaaaaaaaaataaccagaggtgttatgaaaatataaattgtccagaactaccctccacaaactaactctctcagaatattcgatatgaggaatgaaatatggtgtgtgtgtgtgtgtgtgtgtatgtgtgtgtgtgtgtgtgtgtatgcacctatatatggcacctatatattcaacaaacaattctgataattggccagggttgagaatgactagcagcccagcatacactatcagttttaagtatataattgcgctttagtaaaatgtaaagaaatcccagagtagaaatacttttaagctatattacaggtgagaaaatgcataagtatagtctcacccaacttagactatgggggctttataatgtcacaacagttgtttccaggcatttggggacatcaccactggtcttgggcaagaaactcctctagccaatggctgatttatctcactcccatctaaggcttcactgcatttctctttttcagcaacctaacttatttaaaaatatccattttctgattcatttttttctgaattaaactgtcagtaccattggcacacctttggttccgtagcatacctgtgtctctgctgtggttttttttacctccactccttacttttctagaaaaaaatctctgctttttcttttcagtttaaattatttcacaaaaagttttcttgacttgcacttcctaggcttgctgtccttgtgtgggcacgctcccataaacactattaatacacttcgatttgttaaaaataaagatatctggacagaaaatttcttttctttttttaagattttaaaatttttaatgtttatttttttcctagactggagtacagtggcaccatgatggctcatggtagcctacacttccccgggctcaagtgatcctcccacctcagcctcccaagtagctgggactacaggtgtgcacaaccacacctgactaattttgtttatttgtttgttttgttttttgagatggagtttcgctcttgttgcccaggctggagtgcaatggcgggatctcggctcaccgcaacctctacctcccaggttcaagcaattctcctgcctcagcctcccgagtagctgggattacaggcatgcatcaccacgcccagctaattttgtatttttagtagagacggggtttctccatgttgaggctggtctggaactcctgacctcaggtgatctgcccgcctcggcctcccaaagtgctgggattacaggcgtgagccaccacgctcggccactaattttgtatattttgtagagatgggctttccctgtgttgtccaggctggtcttgaattcctgggcttaagtgatctgcccaccttgtcctcccaaaatgctaggattactggcgtgagccaccaggtctggctggaaagataatttctaacattatcctctcttaaacatttgtttcaaaaattttacaaacatgagagtaattaaatttgattttcaaaattcccttgaatactttcttaatagcacacagaaagcacaaagtattttacatttgttttaatgatgaaattgtgaacccaaacttacacaaagaaaaaccgtaacattatacccatacttaaaacagatgccctcatatacatagtaaaactcttgggggcagtagtgaagttggttatttactgttttatgaaagtgccattcagccgggtgcagtggctcatgactgtaatcccagcactttgggaggtcgaggcaggctgatcacgaggtcaggagttcaagaccagcctgaccaaaatgatgaaaccctgtctctactaaaaatacaaacattagctgggcgtggtggtgtgtgcctgtagtcccagctactcaggaggctggggcaggagaatcgcttgaacctgggaggcggagattgcagtgagccgagatcgcaccaccgcactccagcctgggagacagggcgagctccgtctcgaaaaaaaaaaacaaaaaagtgccgtcatagtgacttagttttaaggaataaatcaaggatatttaactcaatagactacagttagctaacgtgacttgcactgaaagttatacgaatattggtacttattcccctgcccctgaagtatgaattaaagactccaaaattctttttagaatcttcagagtaaaagctagaatttgatttttttaaataataaaaaaatactttgtatctaaatctggtgtataaaataacttggtggatgatgcttcaaggctatccatccccaaatttctccctgaatgataaagagaataaatgaatatgtcaattcaaaagttagaaatttggccgggcacggtggctcactcctgataatcctttcggacgctgaggtgggtggatcgcatgagctccggagttcaagaccaacctgggcaacatagccagaacccgtttcaataaataatagaaaaaaatgagccaggcgtggtggtcccagctactcagtaggctgaggtgggaggatcacttgagctcaggaggtcgagactgcagtgagccgtgatcgcagtactgcacaccagccttggtgtcagactgagaccctgtctcaacaacaacaaaacaagttagaaatttggctgggcgcggtagctcacgcctgtaatcccagcactttgggaggccaaaaagggcggatcatttgaggtcaggagttcgagaccagcctggccaacatggtgaaactccatctctactaaaaatacaaaaaaacttagccgtgcatggtggcatgcgcctgtagtctcagccacttgggaggctgaggcaggaaaattgcttgaacccaggaggcagaggttgcagtgagccgagatcatgccactgcattccagcctgggtgatagagtgagactccatctcgagaaaaaaaaaaaaattctgtatgaactgaacaaaatatccttaaattttaaaatacatctgaaagatatttcaaaatatttaggaaaaaaattatagggatcaggcaaattctgagattcctttttccctgcagcaaacattaggagtgctgctgttcctaaaaacatggtaactgttgccacaccgtatgtttccttggctcagacataaggttgtgtagttgttattccagaatagctagaataaaaatccagcacatcattttcttcagcaagttaactaacctctctgtgccttggtttcataacagcaacataagcataacagaatagcagcaatagctcctacctacctcataagattctttggaagaattaaattaagattcagaacacagcctaatatctagtaagtaataataattggctaaaaaaattttcttaagattatatatattcatggggtacaagtacaattttgctacattaatatattgcattgtggtgaaatcagggccttcaatccatcccggaaaaaaaaagtttttgaaaagatttctgccatggaaaacttttaatgtacaaattcatccatccaagaaatagaaaatatataagtatcaactccaaatccaccatatctatctcttctgcaccttaaacaattactcagaaatagaatgcttgagataccagaatgcatgcatatcaagtaataaatgcatgcaggatgtcaacgcatcctaggctttcaaataaaattgtcatacaaaatactttaatattgtagtaacattctacatgttagagtgtagaagttaatcgctgatgcaaaaaaggaaaagaacacattatacccaaagcctacagagagaatcacaattacaaatatcagcctgcatgtgaaaatctttaatttgaaagtcagaaatatttaaatgatagtcattgttaaatcagattgtggtttgaaaaaaagttagtttaaaactgagtttatgaaaaatttggggattttagagacagtgttttgtttttaaatgtgtgtgagtttgtgaagaatgttttataaaatactgacagtattataagatgacattattataatacaacataagaattttggcctgtacctctcagcagtcctcaatcacctgctgtacttgactcaatgattatcagagtggtttgttttccttctgttgtgttcccagttcaggcagctcagcaatggcctgtgattccagcaattcaaatagctggtaagtagtttcttgtttgttttctcaaattttcaggggcttttctctacaagtgatttccagtgcacgcccctccacccattctttattcctttaccttcaggaaaaccctcagcgctgcatctctggtcaccggaccaccgtggtacatttacctatggccaccaggtgtcacccttctctttactaccatggtttgtgaatggttttgccagaggtgaataagaatttaaaatgcaggtctttgatttttcaaatgtagttgaccttaagaatttatgaataaagccagaaaaattaagcttaaaaaacaccgaaagaaaatgaggacttaaaatttctattaaaaaaattaacaggccacagttgctgatgtttagtaaatgtgttagtgaaatgtgttactgtgaagactggggtgtttcttgaaatctcagcccaggtgaaataaaaccaatataaaacaaatgcttacctaataaattaattgtaacatattccttatgaggtagaagagtaagtgaagccttatagcagtctgctttcagtatagtaagatattaagagagaaataatttgtcatatgctttcagaatggtttgctggtaaaataaccaatgtcttacaacttagacgacaatgtccctagagtgaagaaacacgattaattcggctaccacagttgaatgaaaatattccgtaagacaaaatgtaaagaaattagaagcaaaataaatgtctccaaaatgacaaagcgattaagtatatacacaagatgaacaagaacttcaataaaatcatgcagtatacaatacaatgtacatttattaaagtatatgcatttttaatgcaacaataatactaacaggtaatagacaagttgttaatagtttttcactggctaattaaataacagctttaattgtattcattttatagcttttctacaatgagcgtaaatcacatttacttttttctacataacttttctaaccacaaaaaaagaaaatggtttaaaagaagagatgagatatctttgctaaaatttaatgcctaaagaagaaacttctgagctgtatatggtatcctgaagcacctgcccttcaagacagaatgcttgtaccacatttatgcagccaagtgcatgtagtaacataaagtaaacacatgccatctggatatatatattaagactcttttgacggctgggcagggtggctcacacctgtaatctcagcactttgggaggccgaggcaggcggatcacgaggtcaggagagttcgagaccagcctggccaacatggtgaaaccctgtctctactaaaaatacaaaaattagccgggcatggtggtgcacgcctgtaatcccagctacttgggaggctgagacaggagaatcgcttgaacctgggaggcagaggttacagtgagccgagatcatgccattgcactccagcctgggcaatagagtctcaaaaaaaaaaaaaagactcttttgaacatggtgaactgatttcccagaatctagcaattcctgaatgtcctggttagattttttttttaatgtgcaccggaaccccagtggctccatggaaggacctgggcatcctctaagccacttggtggcttccattataccatctcaaaatgagagagcttactccacttcattgagggaaataccaccagagttctgactccagaggcactggcctagggaggacaccgtgtgtgaagcccagcagggccactagctgtccccaccaattacagtccttgcgtagggtccaaagaaatgaatgccaaagagagcaacagaggagcaagggagtcacattccaggaccttccttcagggacttttaaaggaaacatgacagctgaggatcagttggttgttttctgctgttccccttcatgtgattcaagctcattcagaagaaacacaatgagacaagagaagagccatctccttccttctctatttattctaggcatctaaactactgaatgtagtggtgtctgagatgtatcaaacggtcagattgactgagtttgaaacctgtttctatcactgacaaactatgagatactctatacttcactttcttttttttttcatttttttatttttatttttatttttttgagatggagtctcactctgtcacctaggctggagtgcagtggcgcaaactcggctcactgcaagctctgcctcctgggttcatgccattctcctgcctcagccttccgagtagctgggactacaggcgtctgccaccacgcccagctaattttttgtatttttattagagatggggtttcaccatgttagccaggatggtctcgatctcctgacctcgtgatccacccgctttggcctcccaaagtgctgggattacaggcgtgagccaccgtgcccggcctacttcactttcttcatttaaaaaagaaatggggataatagtacctatctcatagaattattgtaagaagtgcatgcagtaatgcatgtaagtaggtgctcagaagagtcggacacgaagtaagtgcttttatcatccttatcataattttcattatcagaacaaggagagaccaggtagaaaattattgtgattcttcaggtctggaatactagagtagcatcccaaatgaaggcaccattaaactttgcaaatctgtatgacaccttcatgccaattagaaaaaacacctcttcacaacccctttcaagatatttgcctcctacctgctaaaaacacccatcatactacccacagatagccatgatgctttttctgggacaggtgcctcttccattcgtgcagtgtacagccttcatagctgtgcaactcacatcacaatcagatggaagaatccccaaggcttggtgacagatgagttactgggtaacacagagagaggattcaaaggaaaagttgaacgggtccagaaaatgcatagatacatgtgtaaaaatctggtaaggttatgactagccacgtcccagggttcaaagcttttctcagatgttaaaatgaatcatgtaagtcccccaaatttaaggagtcctcttccaaaaataggaaatgaaatgacataggtgtatgtctctgaggtgacggaggaaatgaaggaagcctctagatgcagcttgaggttcatgagagacagttccaggggagaggtcacagctagggatcaccggcatgcaggaactcagaaacctaaatggggaaatctttttgaggaaatgaacagagaaggctaaaatcaaggagttcgtcaggcaatttctatgtttaggttcaactctctcctgaaacatgaagagctcataaatgcactccctctttgagtctctagttttgtctccttcccacagtgagtctgcaggctgcgtgtcactcacgttcagctaagacgtagtgccccatggctcctcctgtggagacaagagacccaggaaagaggcatcacaaacctaggcaccatcttgcctcttctctcttccttattttcctcattcacccatctcaatttagacctgggcactattggatttcaagaaccattatctctcatctggaaatgcttattggctttctaactggtctcctcacctctcatctaacttcttaacaacacattcaccatataagggagatcgtggtcctcctttcttaggatccttcaatgacaccccagtgatcataacccaatatcccaaaagacccttggactctgtatgagctggcttctttctgattctcttttccctacaccacagatgttcagggggtagaaatgcataattggtgagtgatagctaagcaaactcagggttaaggtacagtaattatttctaatctcccagtatgccttatactctcctacttggcatggttgctccgtctgtgtagacctcccatcatcttcaacctcacctaatggaatccagcttctccttcaagatccagaaggctatcttgatccccagctgaatgtgatcattctttcctttgacaccctaagcatttgcttcctgcctgctttaggacctcatggggtcttctttaactacatttacttgctatcaatttcattccctaccagatttgggttctgagaatagccacagtgacttctcaacctcaaagcccctgtactaccttaaacagctcttgcaaaatagtaggtgctctgaagatgtttgttgaattagagactttcattctggggagaaccattattttctgtctcccagggagctgctggtgtccccaaagaatataaatgagaaaaatgcttcccatggatgccagatcccctctgcccctcttcccactgtgccctggggcagaggtactaagagacttcccccttgttcctactcacttgaaccctgcctcttccttaatattatgaacaaaattccaatgaacaagatgacgacaaaaacagcaattccactgatgactccaatgactagggtgccagacggtgagggctctaaaacagaaaaagcaagttaaagcctttgattgccaccctcagcccaccccctaacaaagagcagatcctcatctcactgccataattacctcctcaggcactcctctcaacccccaatagattttctcagctcctggctctcatcagtcacataccccagatcacaatgaggggctgatccaggcctgggtgctccacctggtacgtatatctctgctcttccccagggggtacagccaaggttatccagccctggtaggtcccatccccattgggcaatacgtctttaggttcgaactccttggcatccattggctgcttatccttcagccacttcatggtgatgttctgggggtagtagttcaaggcccgacaccgtagagtggtcactgaagaggtcacatgatgtgtcaccttcaccaaaggaggcacttgacaggaaagaggaaggatgaggagaggggatctgtttacccttgccaggaagactggaactttcacttccttctataggttggaggaaggaaatacccttttcagaaaaaaacaagctacaggagagacaccattttgtgtcctaagattggactctaacacagtgtcacttggagagcagtcagatcagcttgttctcctcacatgtaaatatacatatctgttacccatgttctttgttctgatagataaaattgccctttatgtgcattgaaaatgattgaatacagatggtcagtttcacctgggtcaacctaggaggcattgttataagaagcggacttgtaagataggtagcttcagtgattattgctatgttctatgaaagaaacttttaacctaaaggattcttctactctgataagtggcctcacttgatattttgtcctggtattcatatgatagctgagatctctgaattctctttttttttttttttttttttaagatggagtctcactctgctgcctaggctggagtgcagtggcgcgatcttggctcagtgcaacttccgcttcccaggttcaagcgatgctcctgcctcagccttccaattagctgggactacaggtgcgcatgactgtgaccagctaatttttgtatttttttagagacgggtttcaccatgttggtcaggctggtctcaaactcctgaccttgtgaccacccgcctcggcctcccaaagtgctgggattacaggggtgagccaccgtgcccggccttgacatttctgaatttttaacaggtataaatatacaaaagattattggttaaataaaaagcaagggccatagacacttccctttgagccatatgcatggagaaaagaaattaaacccatgacttgtggctgtctcatacatctcaattataaggtagagactctaggattgagaaagtcccttcccagaatttggagaggcacacagcctcagccacctctgaaactccaaccagggattccgtgccctgcaacctcctccactctgccactagagtataggggcagaagtgtgtttccaccataccttgttggtccaaaacacctctccccagctccagcaactgctgcagctgtgcagggcagtccctctccaggtaggccctgttctgcctggcccgaatcttgtgcctttcccactccagcttggtgggccaggccctgggttctgctgctctccaatccagtgtgtcagggcagaattcaaggtggtcctgcccatcatacccgtacttccagtagccctcggtactgttgtcttcttgcatttcacagcccaggatgacctgcagggtgtgggactctggaaaaatccccagccttgttaactgcaaccaaaggaataggtccctatttccaccatccccaaggaccaaatgatctcaggaagcaaattccttccctcttccctgctcccacaagacctcagacttccagctgtttccttcaagatgcatgaaaagatgaaaagctctgacaacctcaggaaggtgaggccccctctccacatacccttgctgtggttgtgattttccataatagtccagaagtcaacagtgaacatgtgatcccaccctttcagactctgactcagctgcagccacatctggcttgaaattctactggaaacccatggagttcggggctccacacggcgactctcatgatcatagaacacgaacagctggtcatccacgtagcccaaagcttcaaacaaggaaagaccaaggtcctgctctgaggcacccatgaagaggtagtgcagagagtgtgaacctggagacagagcaacaggccttaaccatgtgtagtaggaggggagcaggatgttgaggctccacacacctgcatcaactcataccatcagctgtgtctggtcctcattttgtgaagggtgagttgcagtcctgtctttcttccatatgacagtcctgggtgctctttccttgtgtgcttttctctgccacacgtggctgccaccccctcactgcccccagatcctattccaatactcatgattagacagactccactaaagctggtggattctagaaaatgttaaggtgtgtctagccatggtagttgaactcaggagttggtgctcagggcaaattagacccaaatcctgaggaataattccttcagtttttttttttttttttttttttttttttttttgagacagagtctcactctatcacccaggctggagtgcagtggcacaatctcagctcactgcaacctgcacctcctgggttcaagggattctcctacctaagcctcctgaaaacctgggactataggcgtgcgccaccacaccaggctaatttttgtatttttagtagacatggggtttcaccatgttggccaagcttgtctcaaactcctgacctcaaatgatctacctgcctcagccaccaaagtgctgggattacagaagtgagccaccgtgcccagccttggtcctgaattcttacactgaactgcctatgtggcctcaccacttggaagcctgactggaatctcaaacttaacatgtccaaatgcagatccttgatttaccccaaactgctctttcctctgccttcaccatctcagaaatggcattgccaattaccccactgctcaggccaataaaattaaaataaagaacaaagtcaactttaactcttctctttttcagggggtcaggggagacagggtcttgctctgtcacctaggctgaagtacagtggcacagtcatggctcactgcagcctcaacttcctgggctcaagcaataccctccacctcagcctcccgagtagctaggatcacaggtgcatgccaccacacccagctaatttttgtattttttgtagagaaggggttttgctgtgttgcccaggctggtcttgaactcctgagctcaggaatctgctctccttggcctcctccttggcatgagctactacacccagccaattcttctctttctctcacacaacatagaatccttcagcaacttccttcagaatatattcaggagacaatggtttgtcactcccttttctgttcccacccagcccactccactacctcttgcctggactgtgtaacagcttcctggctgggctccctgcttttactgttgctcccttcattctgctttccacatagcagccagagcaatcttttaaaagcctgtgacagatcactgttactccttggctagaattcacaccacagcctacaggcgcctgcacaaccttgtttgtggctcctcttctgagcccattacctacttcttggcctctactccccagcactacttgtttatttttttcaacccgagcttcttaaccaggagtttgtctactaggtgacatgtggcaaagtttagagacatttttggttgtcaagactgggggagtgctcctagcacctagtgagtagggaggacaggatactgctagacatcctacatgcagatggtagtcccccttcccacccccacgccgcccccccccccacacacacacacatgagtagtgctgagaaaacccgctttttaatccaacttgccaggcccactcagtttgcctgggaaatactgctcccagtcaatatcattcttatttccttcatgtctctgctcaagtgtcagccccagagtgacttgccctgacttctctgcttctcacaacacccatgatttcctgatgttgtatatctttctgctcatttgcttattgtcatctctcccactagaatgcaaaatatcaaagggtaaagacttgtttccctgctctctcccttggggcttgaacagtgcaacacatggctgggactcatttacacttgtaaacaatgaatatttctgctcaacatgaaattttattattcaacctctaatgcagtgtgatgtttaagaatcatagctatgaagtggagacatgagctctgccaccaaagccccgtgtaccattgaataaatttgccaggaagcaggccgtgccatgcctcattcttgtcatgtgtaaaatgtggatacacgtagtaccaaaactcaaagtgctgtgctgaggccggcgtgtgacccacagaacactgtgctacactacagggcaaaatcactgtcaactaagattagaagcagctgtagtacttgaaataacatcagaaaaccagattatttatgttctttgtaacctgaaaagagttatataatctgaattccagttaacttctagtaaaataaacgtattattagctcctacctccctatgcctagtgaaaatcaaataagatcagatatgaatgtaacttagaagtgagtgcattgcttacatgttcattatcagtactttgtagagaggcctcttaattacacagcacattgcaaatcaataaagcctagccgaaaagagaattgttcagttcaaacgttcaaaactaacatatacttaattttccaggcaaaagaacaattgccaagagtggggaaaggcccgaggtaggcctctctcaggagcctcccaccctagagacctccaccccaggtctcaccaaaagtgggtggaatggtgaagaattcagatccccaacgccactctttcgcgcccccaccgcccaacgcattcgttctgaggtggaaaccccgtgcggatcctgctgtgggtttgctcagccttctcggcaagcactcagggaagaacttcctgtttggagatgactggggaaaaaactgcacagctgacattggaaataaacccgagttccaggttcaaggagccccaggcttagctcagctcaagtgaggaactacgagatttatttaaaagcattctagttgggggaagggagtgggcggttccaaaagtcactccgcagagccgggacagccgggggagggggcaggtcctggggcgagggacccctatctgcagttcagtggtaggcactccctcacggggtctggacgcagaaagtagggagaggggcttgcggattgggttgagcaggtcctccaaagttagcaaactcccaagcgcaaagaaaaagctagtttcgatttttccacccccgccgcgcccctagttcgcccgcagccctcggactcacgcagcaagcgcccctgcaggaccgcggtctgcaaaagcatcaggaggagaagcgccggcctggctcgcgggcccatttccccagctctggccgcacgtccccgttaaatctccgcttcttttggggggcggggaaacggggatggctccagaagtcaccctacagctattgcctaggctcaggagatgcccagtaaaacttcctggtgaaaagcaacaggtctttcagaactttagttctctctctcctacagcagaaggtacctgcttgtgaaacactaggtgatccagtgtcccccttggtttttaaatcctgaaggggtgttgttgattggggaaagtagcttcgcaatgttctgatctgaactttagatatttaaatatttatgattttcaaaattcaatcatacatttaaaaattttatctcaaccttagaccaacttatgtcttatttgacttagaaatataaagctttttcattttgttttttgattcaaattaattaagtcataacattaaccaattagatcctactgaaacacgttccacagccttcataattgaattatctgacaagtgtttcacaaactttacagtattgggattatctggagaatgattaaacatattgaggcctgctcctaaccccagacacactgatttaatgggtaattgttaggtagttagacattagcagttgggaggggatgacagaagagagcggaaaggctgtcactaagacagccactggcccacctaaattcaggcccaagactaccctaatgccaccctaagggatggagtttatgataaagtctgtggccaaaatatcctggagaaagagaaaggagggtacaggtggaaattccctaaggtggcacatgcccaacaacacaaaagcctgtcttcaagttcaccccaagttcatcatgccatcattataatagaatttacatacagttttgcccccccatccctgggaggcttttcttaacaaattataggtaagaccatgcacagtttaattttagattgtatagctataaacttcaatcaaataacatcatcctgtcactcagatacagcccaaacctcaactcctccccacaaaccccataaaagcaccttgagctctgtaaagaagtgctgagttcacttcgcagaaataagcccgctgtccctcagagtgtattattgtgcttcaataaactttgctttaagcttgcattttggtgttagtttgtagttctttgctcactatcacaagaactgagattgctgcttcagagctccggctataataatctcctcggttaaaggatccatcccaatgcataattcccagtaacagtatgggatgccacctgggcaatgggattttaaaagctttccttctccctcaacgaagtttgggaattattgccttagacatttcaaacaatattaataaatttaatacacctgatttgctccaaacctttacatatctagcaaattcaacaggcattatttttgtaagcatgtatgcaaattttggcaattcaagaaaatcaaacaggatatcagggcctcgactgtaggcaaacagatacaataacattggaaacatgtagaatattgatgatgggcacattggggctgatagtactattcctttttttcaatttttggtaagatataattagcataccatataattcatctatgtaaaatgcaaaaattggcccagctcagtggctcacgcttgtaatcccagcactttgggcggccgaggaaggcagatcacctgagatcaggggttcgagaccagcctggccaacatggtgaaaccccgtctttactaaaaatacaaaaattagccgggcgtgatagcaggcaactgtaatcccagctacattagaggctgaggcaggagaatcgcttgaacccgggaggcggaggttgcagtgagctaagatcgtgccatcgcactccagcatgggagacaagagcaagacttcatctcaaaaaaaaaaaattagctgggtgtggtggcatgcacctgtaattccagctactcgggaagctgagacaggagaatcgcttgaacctgggaggcggaggttgtggtgagccgagatcatgccattgcactccagcctgggcaacaagagcgaaactccgtctcaaaaataaaataaataaaataaaatgcaaaaattaatggattttagtatatttacagagatgtgcaaccattaccaaaattttacatttctatctccccaaaaagaaaccatgttcccctaattcagtacccttaattcatcgcctcccagattcctccattctcctcctcctcccctcccagccctagacaatctttaatctactttctttctatttggaacatttagtatacatagaggcatataatatattgctttgccgtgactggcttctttcatttagcataatgtttttatgtatgtttttcatggaccaataatatctattataaggacataccacaacatattttatttattcattcatcagccgatggacattggtttgtttctactttatggctattgggaatagtgctgttataaacatttatgtacaagtttttttgtagacttatgttttgatttcttttggttatatatctagaagtgggtttgctgggtcatatggtaacactgtttaaccttttgaggaattgccacattcttttccaaagtaagcattttatcctcctatcagcagtgtatgagagttctgatttctctccatctttgcctgggtttttgaatcagggccccagatagaacaaaaatgtggttattcagttgttccaccatcacttgttgagaagactcttttttcattgaagtgttttggcacccttatcaaaaatcaatctaccataaatgtgagagtttatttctggagtctcaattttatcccattatgctataatctataatcctatctttttttttttttgacagagcctcactctattgcccaggttggagtgcagtggcccaatcccggccactggctcctcctcccaggttcaagcaattctcctgcctcagcctcccaagcagctgggattacaggtacctgccaccatgcctggttaatttttgtatttttagtagagacggggtttcaccatgttggtcaggctggtctggaactcctgacctcaggtgatctgcccacctcagcctcccaaagtgctgggattacaggcatgagccaccacacccagactataatcctatctttatgtcaggactacactgtcttgattactatagctttttagtaaattgaattcaagaagtttctcaacttcaaatttgatctttttttggaagactatattagctattctcagtctgctgaatttccctaggaattttaggatctattatcaatgtctattctatttttgtatatgttttaatattttcataagaaacttttttcatttaaacttttttttttaagaaaaatagtgaaaatcagaatactgggggtcaggcgcatttaacaggcagaagaagaataaaaacttgtcatataaacaaaaaagaaatgaccaatcacattgtggaagccatggagtggttataggtgccaaaggctgcagagaaatggtgtcagatatacctgaaaattgtccattgtatttggccattaagagacttagaagacttaagccatagattgctcagtgagaccccgagggcaaatggtctgaaggtgaatagatcatttcacctttaagagagcaggtaggaagctataaatccaagattaaaaagttgactgaactgttaaagaagaaactctaatcttgagccaccctatccttgctccaccttctgctgcaagcaaacagaaatgctgaaattcaacactcacaaaggctggtaagctggaaatgacaaaaattactcctgggaaagtcagatttagaattaggccatatttgttggggttcagattttcatgtacacttgggaaagggtttagcttataggcacatgcatgaagggaactggtatagggctgtgttcataaggtcaagagttgaaggccaggcatggaggctcttgcctgtaatcccagcactttgggaggccgaggcaggaggatggcttgagcccaggaattcaagaccagcctgggaaacatagggagatgctgtcttcacaaaacaattaaaaaataaaattagtcaggtgtggtggcacacacttgtggtcccagccactcaggaggttgggaagatcacttaagcctgggacattgaggctgtagtcagccatgatagtgctactgcacaccagtctaggtgacagaatgagaccctgtctccaaaaaaagagctgtatccacatcccaggaaagtggttgaagatctacttttctctgtaaacctaataaagaatagagtgacaaatgtgtgttgtggaaagaaatggggtgagagctacgtagatgcaaaacaatacatccccacataccacttgttaatcatccttttccacccacttatgggatgaattgcatctccccaaaagatactctgtcctaaccctcagtacctgtgaacctgaccttatctggaatacggtgagttcactggttaagaagagattatagtggaatagggtgagtcctccaaccaatgactggggtcctcacagacacagagggatgatggccaggtagagatggaggcagagattggagttatgctgccacaaaccaaacacaggaagctgctagaagtggaaacaggcaagaaagaatccttccccagaggctacagagggatcttggccctgataataccttgatctcaactggcctacgtaactgtgagagaataaatttcttttgttctaagccacccagttgatagtactttgttacggcagccctaaggaacttgatatacatttcttttactgtcatagaagttttgaatcttttaagtaggtctgtacccttcctcccagtgtcaacgcatggaattcctctccttgtgccttgaaaagtgaaaggtgtttgaactggtaatgaaagaaatctcagcatgaggccagatgctgtacctcacacctgtaatctcagcacttcgggaggatgaggcgggcagatcacttgaggtcaggagttctagactactctggccaacatggtgaaaccccatctctactaaaaacaaaaaatgttatcctagccgggcatggtgcctgtagtcccagctactcaggaggctgaggcaggagaattgcttgaacccgggaggtggaggttgcagtgaactgagatcacgccactgcactctagccttggtgagagagcaagacttggtcttaaaaaagagaaaagaaaaatgaaatttcagcattatagaataaaaatgtttccccttccccccaaactttaaaaaagcagaagtctgcatcataaaatggtctttgccaatgttatttttattataacaaaggaatcttgcaaggctaccagatctcagcaattgtcactatgttctgtaaaaatcacttcctaaaatgtctgaattgactgcttgtctcatttatttgtttctcgtgtcatactgcaatggatatctgtcttgttagtataaatatttgtgcattttgttgttgttaaaacagcttttttggcctgtcttcttccacctatgaggtaatataaaactcatgtttaacacttatttttgtaggaggacaagctacagacaaaacccctcagacactgagttaaagaaggaagggctttattcagctgggagctttggcaagactcacatctccaaaaaccgagctccctgagtgagcaattcctgtcccttttaagggcttgcaactctaagggggtctgtgtgagagggtcatgatcgactgagcaagtgggggtatgtgactggcagctgcatgcaccagtaatcagaacagaacagggattttcacagtgtttttccatacaatgtctggaatctatagataacataaccggttaggtcgggggtcaatctttaaccagacccagggtgcaacaccaggctgtctgcctgtggatttcatttctgccttttagcttttactttttctttctttggaggcaaaaattgggcataagacaatatgaggggtggtcgcctcacttattcaccccctttgagaatctcactcattagtgggagttctcacttttattctcactacctatgtcttcttgaaagacagattgataatgattcatatagtacacttgtgctgaagcattttggtgagctaaggtagtgatgaagctttttatcatttggagaagtacaggtagcaaacaaggaagcagtaagcaggtttctattaatattataactcctattataagagttttaaatcttcttagcactcggaaccatttttcaaacatggccccagaaacaaatccataccacacctacatgggcacatgtgccacttttgtcatatttctaactatgtcttcaactacttgcccttaatcatctatgtgtagacagcaattagtaaggttaaatttcctacagacccctccttcagttgctagcaagtagtcgagagccaatccattttgatagatagcattttgcatctgagtttcttgccaggccacagtagtcagggctctgctggtcttattagtaattatttctaagacagcttgtaaccgtatgattcagttgagcatgtaaatgggggtcccatatccccacaagccgtcttgtgcccaagtagcaggcccataatattgtatgattctctcagggggccattcattatttttccaattttctatagctatgcttttttttttttttttttttttttttttttgcgggaagcatatacagggaagcccaggagtttgcctgtctttatgggcagtaggaagaaagatggtttaatagtgtcaataacacaactacctgcccactggtcaggtaatttggcataagctgtatgcccacatatccagtataatccagtgggggctgtccagtcccggtgggactctgggtgggtccacacagtttgcaactttgggaatttactaaatagatttttcttagtgtggtttgaactccactaggtggctgtttttatagtactattatacagtttttgcccaaggcagctgagtcttcccacaggaagggtgaagtccttccccacttttgctatacagtattgtctaatgattgaggcttttaggacccagaagttatcagggtgagtcttttgagctgggaatttatcaggaactgggtctgtaggtactaattctcgtgcttcccatggccattgatctcccattacagttcctccacatacatacataacatgaagtgacattgagagactgggctacatgctcagctaattgcaaaaacaaatttcttgtttttcctggaatttctagtactggcacattcagttcatcataagaaggtttgaaatactggctcaggggagcatttataaacttctcctcaaaccaccatatttactcaaggatccagtccagccccaactatttctaaggttacacgatccccttttttccagtgagaatcaagggggttggttattactagttctaaggggttacactgaccactggtacaggaagggccacttttccctttctgaaggtggacaggattctttttattttttaaccaagttgcctaaatgacacaagaccagtatctacatttatttccacgcagtcttaattcatgacaagcgtacttattttctgccatatagcctctttcctaatgaacagaaccacatcctatttctaacttattactattaatgacagcacaggcatcaaatttcaaggtgacttgtttgggcattcctttttcttctgttttggctaacactttactcgtatcgtttatgaacccccaccagtcctcagtcctcaatcttatttcaaaaactgtggtcgtgggaggctcagatgggtcataacacacatcaggttggtcatttcttgggctacctgccttgtatagaatagcattatacaaacaagttatttttagagtctttgtacacttataataaccataaaataataagactgtagcaactttttgtcctacctcagtgacttgatgtatacactgggaacagccctcagtctgaggaaggttagttgaagtctttactgtgcaagtccaaattttaaggaaaatgagtcccttgatgagttttctcatgtttcggccatgcatggaccagtcagcttccgggtgtgactggagcagggcttgttgtcttcttcagtcactttgcaggcgttggcgaagctgccacgtacagctcacagtctactgatgttcaaggatggtcttggaagttgggcccactagaattaactgagtccaatacctctactcagtcactttcaactgggctttctgataccaggagcaaggtggcaggttttagggtgttgcaaatttcaatggttatgcagggattttcacatagcaaactttggtacttggttaatctagcatttgttagccaatgatgtatttattaaagtcaccacagcatggagggcctttaagtttaggttttgtccaagagttagcttatctgcctcttgtgctagcagggctgttgctgccaaggctcttaagcatggaggccaacccttagaaactccatctagttgtttggaggcccagcctcggccagggccccacagtctgggtcaaaactccaaccgccattttttctctttctgacacatagagtgtaaagggttttgtcaggtcaggtagccccagggctggggccgacatgagtttttcttttaactcatgaaaaactcattgctgttggttgtaatagatgtagtttatccaatctacatttttattaactgtcacccaccaaaatattgactcaaatcctgcagctatttgattttgggatttaaattgatctgctattccctgtgggactccaattgcatctaaatagatgtgagagttgaaagacacataagggtcttctcttgctttacgatgtcttatttttcctccctctggttgatgaaatgctagggtgaaagggatagccaactggactaaagtacaagtgccgctccagttatttggcagagtgcccagtaaaggtccaccacaataccaccacacatccgcttggggatgaacaaaggctgactgattgagaagctcctgaaaattcttaagctcactgcatcccttcaggtctccaaggaatgctaagtttcctccctgtcatgagagacaagaagtgaacttagttttgggagatggaagctggatggccctcaggggttgacctgcagggtgctggactttgggatatagcagagagagcttggcacgacttattactccaggctgtagcatcctggaaaacagttaccatgcagcccatgcctggtcaacaggaggaccaccttagtggaaaggggataatctggccctctggcctgccatgtgcacaagcataacaattggttttgtttaatgtgtggacagaatatttgatccattccaactgggcatttgcatcttggtatcctgcttaattatcaaagtttgttttaagtctttaacttctatgaccctctagtaaaatgaatgtatgattttaggaaattacaaaaaccggttggggcagtccatcctcgctctttagtggtccacacaacattcgaccaactatggcataaaagctctacatcagggggcaagactcctcgttgacactggggtctttattgaaatctctctggattaaatggtctcagtttactaaggctcagtctgaggagagtcaggagggacagaggtacttttctgaagtacagagatgtcttcgacttggcaagtccccacagggtataacaaggcaagcattaaattcaatagtttgaggcaaaattgacttggttatgttaataactagatggtcagaaatagagtgagggaagaagaaagagtaatagaatagatgaaggagttaaatttttcttagctttagtttggtagggttttcccctgggactatggcccatgactctggagggggtggcactttcttgactcgggtgtgatgagtccatccctttttcaccgtatgaacaacagtctcggtggttagcagcacaaggtagggtccttcctaggctggctcaagttttccttctttccaccctttgatgagaacatgatcttcaggctggtgctggtttacagaaaattctaggggtggtacatgtgctaaaagacttttagttttgagggaaaggaaagtggaagataaaccaagtatataacttttaagaagttgaccttttgttttaaatgtggggacatcagcagtggactttatagtccttggtgccttcttactgagaaatttcctttagcacctatttttattagtttttagaccaaagaaagtcaaatgccattttatatttgacaacgcttcttgtatgtttataccagataagctagatttcacctttatattggtgtgttattaatgttaaacttagttttaataaaactctgtagacatatttatttgatttttaatgtctgaccataaggtaagatttttatagacttttctttaaccttttataatttttgttaaagaacaggttagtgctttaagaaaaacccgttgtgtttttattttaatgttcagttcacagaaaaactgtatgataccccttaactttagccaatatgtttagacacagaattttctttacaattaaggtttcaaaacttgcttaaaccttcaaaacaatttttgtaaccttttaatgtaggtaaaaatccacattcttatgcatcctcataatccttttaccaaaggtatattttactttccttacataccttgcacataaactgtttattcaatagttttacatttagaaggaggcctaattacttttaaattatacaacatttcttgcataaatttatttttctaacacacatttttttcatgactttcacagacaattcttcgacatgcctcaactttctgacttattgcaaacatccctttctttaaacaactagttaatttatctcaggacaaggattttccatacaacattcttttttatataaattctgcctcctctttatttcctttttttttttccgaggatgataaccattcttttccaaagcgaacttcttttatgtctgtggactagactgtctaaggccacaagattagaagttactataatacatgttacactgttaacttttagcaaactttacttttgttgaaaaccttgtaagtttgggatttcaattatcctttgctattaataagaccttatttagtccaaattaacttagaattggtatagatggctttttttttttttttaattacctgggaggaaccatctatcctcctgtcctgaagggagttcctcctaggtctggtcagagctttgtatggtaattaagatttagatcccctgttaggaaacctgccgggttaagagaattttcagtggttaatgttaaatcatcttcttttttcttttttccttaggatacttctgaaccggtgaggtgtgctcacaatgaggtttcctgtaaaagttatttttttactttcttctgttagcaaagcagttgccgctacagattgaatgcatttgggccatccgcgggttactgggttaaggatttttgataggaaggccttaatgcttttggaatatgccctgacaacaaagtgccagttccttcccggtgttcagccactgcgttgatcctccacgagggcctgccacgtgctgctctggtgaggcgttccaccggggcaattgcctacctgggagcgctctccagatctgtgtcgctcaaactggctggagttccccgtagggatgctccacagggcaggcctaagtcgcctaaggggctgccttgaccgtccgttaatcacctctgtctccaaaaaccagctccctgagtgagcaattcctgtcccttttaagggcttacaactctaagggggtctgcatgagagggtcgtgattgattgagcaagcagggggtacgtgactggggctgcatgcatcagtaatcagaacagaacagaacagcacagggattttcacaatgcttttccatacaatgtctggaatctatagataacataacctgttaggtcaaaggtcgatctttaaccagacccagggtgcggtgccgggctgtttgcctgtggatttcatttctcccttttaatttttactttttctttctttggaggcagaaattgggcataagacaatatgaggggtggtctcctcccttaatttaaacaaaattttcaaagtcctaccccaagtaaattggcaaatattaataaagttatggcatagaaaataaaaatgattgtaaaaggcgtaaagatatttctgtggggaaaacatttgttcattagttatcagttaaaattctgtgaaaaataaccactagagaccctaaagtacccaggggctaataataagaagggaggaacaccctctcagtccccaccgttacctccccagaagggaagaggaagagggtgactccaggagagctgtggtctcccctccccatatgtccacatatacctgacctcccctccccaaaatatatacccaatatctctcccatatatacatatttatctgacctctccacatatgtatacctaaactttctctatatatccacatatacctaaccctctcacacacatatagctgacctccagtggaggaaaatggggaagagagaagaagttatcaaaggataaatctaggtcatactcagaaatgtgaaaaacaaaaaccacacacagaaaaaaaaaacacacacaaaaaagaaattgataaatttgtttgtgtcaaaattaagaattccggttcaatgaaggatcccatggataaagttaagacactgctgtaaggatggtagagaattaaatgtctgaatcagacgaaaggatgagtaattagaatgcacaaggccaagaagaacaaaacagaaactccacataaaaaatgtatgaggccgggcgcggtggctcatgccagtaatcccagcgctttgggaggccagggcgggccgatcaggagtttgagaccaggctggccaacattgtgaaaccccatctctacaaaaaatacaaaaaattagccgggcgtggtggtgggtgcctataatcccagctacttgggaggctgaggcaggagaatcacttaaactcaggaggcagaggttgcagtgagctgagatcacaccattgcactccagcctgggtgacagtgtgagactctgtctcaaaaaaaaaaaaaaattatatatatatatatatatatatatatatatatatatatatatgaaataaatgaacaagaaatttagatacaggaaaatccaaagcacttggtaatgaaagaaaggtaaagtgatgtgtccttttgcatttaaaagagagcattaacaaattagagagctgaataatgctcagtattggtgtggatatggagactcaggaatcctcatacactgctgatgggagtgcccactccctgggaatattttccaaatatcatctcaaacatatcccataaaggtgacaggaaagtgtgggctgactgatatccttcactgagagaggtggaggtaaaatgaagtcactgcacaatatagagttggaagcaatggattagatgtccacatagttacgtggaagaatccgtaagatacacacacacacacacacacacacctttgtgtatattgttcctggcaggtaggcatggaggtttagaggctttctacatcacacctactgcacacagtaaatggccaggctgagcactgacttccatgaagggagattgaaggtaagagattgaagattgttccctggtctgggaccctgcaactgaatatgcagaaaaaagtacaccccgccaccccgcttcccatctttcctacctgattagaatagctttttcagaaaacgttggccaggggttgtggctcacacctgtaatcccagcactttgggaggctgaggcgggcagatcatctgaggtcagaagttccagaccagcctggccaacatggcgaaaccccatctctactaaaaatataaaaaattagcagggcatggtggcacacacctgtcatcccagctactcgggagcctgaggcaggagactcacttgaagcacagtgatggaggttgaagttagctgagatcttgccactgcactccagcctggacaacagagtgacactttgtctcaacaacaacaacaaaacccaccaaaactttaaatctacctatggccaaatgcctgctaaaatgagcacccaagaagcagtgttcaggaaagtcagatgaataccctaaaattagatgcaatgttggctggtcacagtggctcaggccctgtaatcccaatccttcttgggaggccgaggcgacagatcgcttaagctcaggagatcgagaccagtctggacaacatggtgagaccgtgtctctacaaaaacgtacaaaaatgagctgggagtggtggcgcacacctgtagtcccagctactcaggaagctgaggtgggaggatctcttgaacccagaaggcggagactgcagtgagcagagatcatgccactacaccccagcctggatgatagagccagacccccatctccagaaaaaaaaataaagagagagagagatgcaatatttagggttcaacaagactgaacttctgactcctttccctacctctccagcatgttagattctgggtccttcatcctaaccccctgttcatgccatagccaccctgtggtaccaactttggaagcctggatcttcatcccctcatgataatgagtgtcccattcaggtctccatgctcagcttggcaagagtatctgtcttctcctcatgggacggtcacattcacccagcactgacaggttccattcccactagggtggcaccctatatggtctgagtccaggccttcctggtccctcagtaatctcagcatggtagcacaatcgaaaagggctaggcacggcagcaccatttcccaccaagaggtctgatggctcatcacatagactgaaggagattctgaagagcagaggtggaatgaagaatgaatcctgggctctgctcttcctaggcctgtcttcctctctcccgagatgttagctaactcatgagagccagaaaccaactgcaggctggcctcaggcacttaggtagtgcttcagcctcagcagtccacattctaggaaccctcataatatgggttgaagtatgcattcccacaaaaataaagttgttgaagtcctaaccaccagtactgaaatgggaaaagttcccttgtcccgctcgcatggcatgtgataggagtgtggctaatttcttcagtgcctggctgctcaaacctctaggggaacagtaagacgggcaggttgtgggtctccaaccccatgaccccaccacagtgtctagggttgaatgtttacagctcctgaagccacagtgggtgtgtgttacagggtgctcttttagttttgccatttataggcagctggtgttaaccaactcaattagaccgtctaccttgtcccaaggacagaagaaggctttctgtatcccaggttcttgccttggtgtaccggaataaatcagaccacacctgggcttagagaaagagtgcaaggttttattaagtggaggtagctctcagcagttgggcaaagccaaaagtggatggagtgggaaagttttcccttggagtcagccactcagtggcccaggctctcctgcaaccaccccagtcaaattccgcctcattttgccaggcaaacgtttgttgtgtgctcttctgccagtgtgctcccctggacgtccagctattcgtgtcttgtggcaggccaggggaggtcttgggaaatgcaacatttgggcaggaaaacaaaaatgcctgtcctcaccgtggtccctgggcacaggcctgggggtggagccctagccggggaccacgcccttcccttccccacttccatatcatttaaagggaccatgcccttcccttcccagcactttccccctcctgtatcaggacctgtgaatgtggccttatttggaaatagggtctttgcacttcatcagttaagataagagtgggctctaacccaacataaagggtgtccttataaaaaggagaaatgtcatacacagagactgacacctatagagagaaaatgtggtgagtagacacagggagaatcaccattcaagtcaagcaatgagtctggggataccagaagctgggagagaaacctggaacagattatccctcattgccttcagaaggaatcaaacctgatgatactttgatttcagacttccagcttccaggactgtgtgacgataaatatctgttgttaagccaacaagtttgaggtactttgttactgcagccccagaaaactaatacagtaggtactatggactgaattgtgactccccgtcgcaaaattcatatgttgaaaccctaacccccagtgtgatggtacttggagctggggcgtttgggaagtcattatatttagacaaactcatcaggatgtgtctctcatgatgaaattcatgcccttattaaaagagacaacaggccaggtgcagtggctcatgcctgtaatcccagcactttgggaggctgaggtggatggatcacctgaggttgggagtttgagaccagcctggccaacatggtaaaaccccatgtctactaaaaatacaaaaattggccaggtgtggtggtgcacgcttgtactcccagctacttgggaggctgaggcaggagaatcccttgaacccaggaggtggaagttgcagtgagatcacaccactgtactctagcctgggtgatagagactccatctcaaaaaaaaaaaaaaaaaaagacaatagagccaggtgctgcagctgatgcctgtaattccaacactatgagaggctgaagcaggaggctcgctttagcccaggagttcaagaccagcttggacaaaatagtgagacccccaacttctaaaaatttaaaaaatgaactgggtgtggtggtacacatctgaggctccagctactctggaggctgaggtgggaggattgcttgagcccaggaggaggctgcagtgagccattgctgtccagcctgggctacacgagaacctgtctcgggaaaaggagaaaacagtgagacctctttttctctcctccttctctccactgcctaagccctacaagcacaaaaaggacaccacatgagcacatagtgagaatgctgctgccaccaacaagtcaggaagagagcgttcacctagaaactgaattggccagcacctggatcttggacttctgagcttccagaactgtgagaaagttattttttttttagcgactaagtctatagtattttattacagcagctcaaggtaactaacatagtagaagggatgaattatggagatcacaagtccacgcctccagaaaaagacttccctaaaaattagtctgagcaaaattcgaatgatgaattatttttaagaacttttaagggatctgacaagtttgcaagagctagagaatgctttacaacgtgataatagaatgctctgtgatgacagaaatctttccacactgttcaaaactagctactggccacttgtgactattgtgcacttgaaatgtgactggtgtctgaggagcagaatgtttaattttacttaattttaattcattacaatagctacatgtagctaggggctactggattgaacagcacagctcgagtcttttagagggagacaggactcaccaaggtggatgctggtggccaagcagcaatggcaggtagtacacacacaagaggcagatgatacaacacatccttcccaaacctggagataagctcaccccacaatcccgccgctgaaatagagttgatgttaccaatgtgcatttttatgtccttttccatacagaaagatcattcaacaagtactatggtacttaaaaaacaacattcaattcattattatgacaaaattaaattaatagctcttccttaaacttttaaattcaatttacaatgcttactattggcatttattaatctaccaattttttcccatagaacccatagaacaaataatctaccaaatttttaacattcatttttggcaaggcttttgcaatttgacgaactttaagaagaaaacttataaattgcaatttttaaatctgacatactggacttttaaagtatccaattgactaatgaacaaaactgctccaaatttttcaattcttaaaaatcttaagacaatacttaatatggcaaatcttaacttcttaaactttgtaagaatgctaatcaacttagattggtataaagttgagttaaaaatcacaggatacatcatctcagctataagttttcatgagttgagtttttacaatcacttgaaatgcttagaataggaaatacgtataaattatttaacataaaatattgttacaaaacctctggagtgtcagtttctctggccagactttatgctgcagcacctttgcctgagttcttgtcctgcatccaggaagaattaggtacagaggcaagagtcaagaagattagttttccaatagttcagctcacctagttaactcctgttcacaatcttcaaagttatcagaaacctgcaattgagggttataatccattctttgcagagtttcaaaacaagacaacatttgtctatgaatgttaaaatgtcctagggtagtcacagtcaaaaacacaattgacaaagaaatttagtcacctctgtgatttacaatagcctaacacaataactctaattataactgatgacacaaactcagatatcagaactctagaaatcccctataattttggaacacatattcacagttttcactgaaatatgacctgaagatcaaatatcaccttatttcaacaatcctatataactaaacgtgtcaaatgatcctgtttacctctcctttggatactccaggggccctctgtagcatccaaaagttaggggttagcaaagacaattttgaagctgtaaaggctcaaaacacttaatgaacctctagtcatatctgttctctactcactaaatgctagtagcacctctcagttgtggctaagctgggaggatctcttgagcctagaagtttggggacgcagtgagctatgattatgccactgcactccagcctgggcaacaatgcaaaatcctgtctcaaaaacaaaaacaaaaaacaaattgcctatgctgtggttatctcacaattaataaaaaggaaaaaaaaagtatgcagtctttgtaggtccttggggtttgttggaactcagaaaacaataccccaaaataaagaccgcagaagccaaagtttttctctgatcttctcctgccctcctgtctctgagtcccattctccccggagtctagccatagaaatgagaattcctcttcctcaagttaggtcatagaaatcaaaacaccttttccccagagcccagccataaaacctaaaaatattactctaactttccctctgtttttctgtgtaaaaactggccataaagaaattatctgaactaccttatttgatcatagatcaccagaccgcattccagagaggatccagaaggaaggaatgctgcacagagaggccaagaagaatctagacagacaggccttgctgggtttccctactctgtttattagcaatcctatttctacacggcggcccatactttgttgaatctaaaaaataaaaatggacaatttcccctgtacatgttaatacacattaataaattggatataaattggataatttattaatatacacattaataaattggatgcagccgggtgcaatggctcacgcctgtaatcccagcactttgggagctgaggcgggcagaccacgaggtcaagaccaccctagccgaaatggtgaaaccccgtctctattaaaaatacaaaagttagctgggcgtggtggcacatgcctgtagtcccagctactggggaggctgaggcaggagaattgcttgaactcgggaggcggaggttgcagtgagccgagattgcgccactgcactccagcctggtgacagagtgagactccgtctaaaaataataataataataataataataataataataataataataaattggatgcattttatcctattaatcttcctcttgtcggtggttttcagcgactcttcagaggccaaagagtaagttttcccttagcccctacaggttcttatgtttaatttgttactctcatttaagacataattaaagtggcttctccatgaagattatttctgcatccattatttggtaagattggccgttttctcctttgatctctacttcacactgacccacataaaacatcactgcctgtttttttgttgttgttgtttggagacggagtcttgctctgttgcccaggctggagtgcagtggtgtgatctccgctcactgcaagctccgcctcccggattcacgccattctcctgcctcagcctcctgagcagctgggactacaggcacccaccaccaagcccggctaatttttgtatttttagtagatacggggtttcactttgttaaccaggatggtctcgatctcctgacctcgtgatcggcccgcctcagcctcccaaagtgctgggattacaggagtgagccactgcgcccggccccgtttttttttttttggtttttgcatgtcttctcccttttactgtaaactatttccactaccagcgtagttatcatttctactgcttaataattgttttggggaagtgaatgcatcaacccacatgaatttcttgtctatttgacaatttattctctttaggaatagtattaactcctaaggtcctgggagccagtctctgtacttggctgctccagggtcctacttcagtttcccagcttctcagtactgtcactgtcaattgtgggtaataattatttttgtccaccaaaagactctgtatgtgaatgagttttgaaatctgctgagtaatacagtgtcaacccagttaatgatttgccgggcggcttgatcaggggctgtccaactaccggcattttgatttggagcgtcatctagtgtctgaaagcacaaacaacatcctacattgtaaatgcctttggctacagagattgaaaccaaagcaaacctatgttttgaattgttattcttcagcagttctgctagccttgaaaaatctaaaagttaaaaaaaagctttatatttcattttctgcctaaactctttaaaattgctagttgacaattagatattttcaatttaatgaaatttttttttagttcacagattaatacacaatgggggagggttcttattctgttggacttttacataacctccactttagtgcagtctgctttatggggtcttgtttgaggtgtgtgtgtgtttaagggaatgtggtttacaatcaaaatattgggttgctcttaggcacattgtaaagtcacacacctgtattcttattgatacataatgattaataacattattattacagcctgatcaccatcattattgatatatctaaataatgaattttataattttgcttcctgtcaggcaagagccaatttcagtgctaccatgtttgtatagcagtatttatgtctgtcatcctcagtcattttacttcacttgttcttagccaaacggccgagaagcgatggtcattttacttcaaaaatgaaaagaattaatatttttacgtttcccttaaagaccctatgtttaacctccactcccgggtaaaatggtctagtccctccttttcatatcatctctgatatcttttgcacagccactattacctaccgttttctagatccctattcttcaaacaccaccatgaaggtagagcctgtctgaattattttcttgtcccgtgaactcagtacattgttaggcttcttgaagatgttgatcagttgtttgtggagtgaatgaatcagctagcatgatttttctagaccactgagacaagtgtctaagacacttgttccttcccatgttcttgcctgcctgtgcaatccatgcagtctcatggcttcccagtgcctcagaattatcccctgtcaaacaggcattataatttctgtccactgaaaaggacaaaaaactaagtgtatagctagaagttaaaaattaccggccaggtactgtggctcactcctgttattccaacattttgggaggctgaggcgggcagatcacctgaggtcaggaattcgataccaggctggctaacatggcgaccccgtctctatcaaaaatgtaaaagttagccaggtgtggtggctcgcacctgtggccccagctactcaggaggctgaggcaggaggatcgtttgagccctggaggttgaggctgcagaaaaataggaatatactctctttcaagagttcgtggttttgactgccacctagcgtacatcagaaaaaccgcatgacataggaaatgcctgtgacagaggggtaaggtgagagaggttgatgaagaatgtattgaaggagtgaaaacgcttccatccctctacttactaaatatattagttaagtagttggggcatattttaattcatgcattttgtagatagaaaaacaaaagttttattctgtttgatttagttgatactttaatatgtgtgtgtttaggatgcatgatttataatcagtctgcagcacttcttggagaagtctgaattctcattctccatttccttattggcaacgtgagaatgattacaatggtggttgtctcatagaatgcagggagtcagaatgaaaatagtccatataatgcctggtgcagaggaagggttcagttaactgtctgtattaatattactgataacagtcatgacaaacaaaagcttaacaacaacaccaccaacaacagttgcagaattgagccaccaatttgcacacaagattgtaggtaggatgttttagaaaagttattatttaatatatgtatatatttttgtacttaaaatatgtcagaggttgttctaagaactatttaaatgttaactccttaatcctcataatgacccatgaaacaggtaggcttattattgtctctttacatgtgagaacactgagacacgaaaaggtttattaactcacccaaagtcacacagctggtaaaacggcaaaattgaatttgaactcagacattccaggttccaagacagtctaattattcttttgactaatatactaagctgcctctgtatttttccttgattactttgtaaaagtatgaggaaaatataagtgcttcaagtaaccatgaaaaatataaacaatctatgtatcaactgaagcataattacaaatcctttgataagcaaacataataaaaatttgatatcaatcaaaactttcatgtaatgtaagcaggttgagatgaattctatagtaaaaaagtgcagagtgctggaataccatgctcctaatatattggctaggcacacctgcctgctatcaaaggtatgcacacaccttggatacagaaagttgggactgggtagttatgtgagtgtcatcagaattctttcccacttgggaaagaattgtccatcataagcttggatgatggacaaggagtgagctcccagaacagtgatgtggggatacatcctcacatcacagtgagaatgagtgttctagactgtttacacacctaccactcctaaatgcacacatataattgcttgcacacacacacatacacactcatctcttctctggtggtccagctctatctcttatcattaggcttcttggggctagtacctagggcctgtatcctttcagaggcagctaagggaagcacacataattagaaagaatgaaccagcttgttggatttggtctcttcgcatccagccctccaagttaaggagagtaccatctttcttagggtcaccaaaggaaaaaaaaaaaaaagaaagaaacagaaggatatcatacagcaaggatctaatgcaaatatgcctcaaatgagaggctactgtgtgctgatcccaatcccaggaactgtatgcacattatctaatttaatcctcactgtatttctgggagtattattcccattttacagagaaggaacttggcagggtaaccaagctcatgaatggagaaactgggattaaatataaagcttccttgctccagaactgctgtctttctgctcttccacactaccagctcagctgtgctctctacatgcaggcagttttacaagtttcagattagcctgggacttccagggttttgaatgggttagggaatggggaacttttgggtttactttccattttttcttcatacatatgtaatatataacataaatctatggtatatatgataaatatatggctacatatgaactatataatcacatatatgcattataaataaatattaattttataatattttaaaggttatcaaataaatattaatataaataattaaataattaatactcagctttgttttccaaagtgataaatgcctatatttagcaaaatattttttggaggcctgatagtttttaggagtgtaaagaagtcctgatatctaaatgtttaagaaccactattttaggctgttgtcttctgtcttattttcccagctagactggtaaatacttgaaggcaaacgtttagccagcacattaacattttatgtttttattcttttgtgctctcagtggctgtgtcttttctatcgatttctcacactgtatgatggttatatttgtctgtatctgtcccaccaggtataagttcttgagaggacacactgctaggctgatcttagtttttattatttctcctggtgtcctgtgcttaacaagtgctcattaagtgtgtaaaaacacagcacagtaaaaaactagacattaaaaaataatgtcaaccaatctattgaaatttgcatttccatgtttcttccaatatagtcattgtgtcaggttatgtacttattctgatgaagactattgcctaatatacgtttgcatcttgtgctttataactgccttcatatagacacagattgagaaggtgtaaaaatgtgcatatcctcacaattgacaaattcttatcctttgagggtaggtttgactttctgaaatgctttgacatcatttgaaagaagcttgaagaataagatagctgttaatgacccagtttcctatgtcacttatacaattataatggcaatttcaaaatgttaggtaaatatattttgcaatatattgttccttttgtaatactctctatgtatttatttatatttttaaattttatatttatgtatttatttttctggacagagtcttgctctgttgcccaggttagagtgaagtgttgtgatcatagctctctgcaacttcaaactgctgggcaaaagtgatcctcctgcctcagcctcatgagtagagtagcgggaactacaggcgcatgccactgcacccagctaatcactatttattatgctcctactgtgtgctttagtatattttctgttgttttctgcaacccattttgagggcgtgttagggaatacagatgcagtaactttggtctcagcccttgaggtgaggaaatatttagcctcaggtttaatctaattgttggccatttgccttcaaagattgaaatatgagcaaaactgtggctctgggttatatgttaaaaaaaagtttatggggctgaagccaggcaacagacaagagcccctacaatcttatttaggctgaaaatatcctggagtccctgtattgttggtctcaagcagatagcaacactaacacttactctttgaggcaggcactgccagtggggtggctgttattattagcttcattaattggtgagtcaggaaaaaacagctttaaatcattcaaagttctggcctatacaggatttagtaatattaggttagctacatccaaaagatgacagaaccctactctaaggctgggcttggtggttcacacctataatctcaaaactttgggaggctgaggcaggaggatcacttggtgccaagagtttgagaccagcctgagcaacatagtgagacccctgtctctatcaaaaacaaagaactctaattggcatagtagaaggaaaaagtgaaagaaaaaccagctgtcaccctcattccttacacctgtcctaacaactcctctcactatcctttgaatatatcttggctgtttgagtctctctctagccccattactgctgtttggacttgacattttgctctgcatttttaacttttctaccagggtttccagaccctgaagagtgtggcatgaaacaaaactagtcaacctataatatttatgatgtgtgtgtaaataaaagaatacacaatatattgcattacaatattttaactgtgtcctcaatttgtttgtggctttcttgaggacatcagttttgggtgggacgaccacatccttaatctgaactttcccttggaggtcattcttttttttttgaaatagagtctcgctctgtcacccaggctggagtgcagtggcgcaatctcagctcactgcaacgtccgcctcctgggttcaagtgattctcctgcctcagccttccaagtagctgggattacagatgcacgccaccatgccgagctaatttttgtatttttagaagagacggaatttcaccatgttggtcaggctggtcttaaactcctgacctcatgatctgcccacctcagcctcctaaagtgctgggattacaggcgtgagccaccccgcccggccagaggtcattctaatagactttttttttgttgttgctcacaggcttgttcaatcttatttcaaaatttgagaaatacagtttccatggaacaccaaccagatatcaggttgctatggagttgatagtcaaaagctttgtatcttccagtttttcagaatggcttctaaaggttctgattcagagctcttaggcgaaattgaacaaccaagtgtcaaagtacaacattcaggaagttaaaaacatgactgacatatatgtactatatatagtgagcttgtgtatgtgtcaatgaatgatttaattcattaatgaaggaggaagcagaatcacaattaggtcaaaggaagatacgggagaataaaatatgtatttggtcagggaaaggatgtatactggaagaggaagggaaaatcagatataaagttgtttaatgacttattaggcaatacaataataacttttagggtcattttttctatattaagaattcatttccatctctatgacaaaatccttattaatttattaaacttctacaagtgaatgtttacttttagatagtctggacccaataaaatgtaaacattaagtcagagttactttcacgtaggacagtgttgtccaataaggtaccactagctacacgtgatcattgaccatttggactatagctagactgatttaaaatgttctaaaagtgtaaaatacacaccaggttctgaagatttatcatttaaaaaagaatgtcaactgtctttttttttagcttatttattatatgttgaagtgataatagtttagatatattaagttaaataaaatatcttaaaattaattttacttgtttcttttcattctttcaatgtgaccactagaaatctggaaagtatttatgtgattcacattctattttactgtctagtattgccttacatcatcaggtaccccataagtaggctttttagataattctctaatatagcttggaaggatatggagaaatatttttgcgttgcttttaagttttgcataactttttcaacacactttataaaggatctagaaaagggttggttacatgtttctctgtcttctggcctccaccatgttgccaggaggttggggacaagattctgggtggctggatgtcctaatggcttgaggtctggacttgagatttgcatataaagagatgtgattagattgagtcgactagaaaaatcatattagagaactgaatcacagcgattaaatttacatgtcgatttataaaccaggacaccaatttatagtgaaagaaggtccagttacctggtaatcaagacgtttcatagctattttcatgatggatatacttagctgagttttaaatgagaagggggttcattgcacatagaataagatctaagtgaaatgtttatttatttttttttttttttgacatggagtcttgctctgttgcccaggctggagtgcaatgaggcaatctcggcttctggagtgcaatgaggcaatctcggcttctggagtgcaacgaggcaatctcggctcactgcaacctccacctcccgggttcaaatgattctcctgcctcagtttcctgagtagctgggattagagttgcctgccaccacgccaggctaatttttgtattttttttagtagagatggggtttcaccatgctggccaggctggtctcgaactcctgacctcaggcgatctgcccgcctcagcctcccaaagtgctaggattacaggcgtgagccaccaagcctggcctaagtgacatgttcttatattgttcctttctttctttttttttcgactgagtctcaccctgttgcacaggctggagtgcagtggcgtcatttcggctcattgcaacctctgcttcccgggttcaagcgattcccttgcctcagcctcctgagtgccaccacccccagctaatttttgtacttttagtagagatggtgtttcaccatgtccgctaggctgatctcaaactcctggcctcaggtgatccgcccccgagtctcccaaagtgctaggattacaggcgtgggccacggggcccagccttatattatttcttttactacaatatattagtatgatgcaggtgcttcaattgtttatacactttccataattttgtataattcttataccctgtcactctgaggaatagccggtctaagtgtttttccaccactgctaattcatccatcactaatctcattagactgttaattcccagaggacataagcacacaagcagacaatgtttacaaatgttggacaaatgttatttaataaaacaatggggtcacccttagtctaaaagatgtttcacttttcatttgtcattgaactcttatttgtaggttcccttttgactttcccacaatctaaggctgttctctttaacacatattttcatgaaaacatatatttgagcagaaattgttggggagttgtaatattacctttgtccctaaatatgaatctataattatatcaaatatatgggcagacaatttactttgcctttaatctcaagaaaaaaatagcaattacttggggtcggagagtaaaataagaagtagtgaaccttaaagtagcaaactttagaacagaatagtttcagaggggatgagaagaggtgatttttcagctcatcaacaacagatcttataataaattacatgttctggtacttttcttgtctttctgtgttaaattttgctatttaaaaaaataaatttcaaatacattgttcatcttaaaagtcaagagtgtgttttattaaagtcagttgctttatttgcaactcaaaagatatatttgagttcccaactggagattgtcctatatggtaacttgcgtaaggtatggttactgaaagtaacctacaattttcatgggctgaaattcatttctatattgcagcgtacaaaaataaataaataaaaaatgcttgttttctttgaaaacatattatctcagtgcctctaactgccaaatctattggcttttttgcaggcttaagggctctcccttgttcctttatgatctctatcttgagggccagacctcctgccttacacaactcagagggggacctcagagctctttaaaaagagcccaatttctcgcctgtagagaagtgaaaaggatgccccacccccatctatgaaaagagggatttgatagtttcaatgtcttcaaatcaaagatttaagtctgtagccccccaccaccccggaccctagcaaggctcatgaaccccctcccatcccgccctaattgctttggactggccgtggaatccttgtcccagtccacagttcctgtgcgactgcacgaagaattcacagaggacctgtgttacttcccttgtgaagaaacagaattatcatgaaaatttaggtggaaaccatttcgcttttttcttcaaaaataagggaagcatgtgcccaaccacccctgggaaaaagaaccttcaggggcaaaggagcgaacaggtaatttataagaaaaacagaaagtggtctctgactgccccagacttccttcggagttgggggaattggggacgcctggacgcgttgtttttgcgtttgtggaaaaaataaatgaagagcatgaagcccgaggcttctgagatcctttcctgaccaaacccaagtgatttggtgcggggaattttaatatttttccccttttgtgaggtggaacaaacacaacttgggagcagcgcagcggctcagagcctgccagccaggcgggcgaccagagcaccaatcagagcgcgcctgcgctctatatatacagcggccctgcccagacgctgcttcatcggcgctttgccacttgtacccgagtttttgattctcaacatgtccgagactgctcctgccgctcccgctgccgcgcctcctgcggagaaggcccctgtaaagaagaaggcggccaaaaaggctgggggtacgcctcgtaaggcgtccggtcccccggtgtcagagctcatcaccaaggctgtggccgcctctaaagagcgtagcggagtttctctggctgctctgaaaaaagcgttggctgccgccggctatgatgtggagaaaaacaacagccgtatcaaacttggtctcaagagcctggtgagcaagggcactctggtgcaaacgaaaggcaccggtgcttctggctcctttaaactcaacaagaaggcagcctccggggaagccaagcccaaggttaaaaaggcgggcggaaccaaacctaagaagccagttggggcagccaagaagcccaagaaggcggctggcggcgcaactccgaagaagagcgctaagaaaacaccgaagaaagcgaagaagccggccgcggccactgtaaccaagaaagtggctaagagcccaaagaaggccaaggttgcgaagcccaagaaagctgccaaaagtgctgctaaggctgtgaagccgaaggccgctaagcccaaggttgtcaagcctaagaaggcggcgcccaagaagaaataggcgaacgcctacttctaaaacccaaaaggctcttttcagagccaccactgatctcaataaaagagctggataatttctttactatctgccttttcttgttctgccctgttacttaaggttagtcgtatgggagttactgaggtatcagagacgaattgggtgacggggttggagagtggccgtggtgaggttacagcatttaaacctttattgcggcttctaggtccctgaccggaggcttttctcgctggcggatggttttgggatggcagtcccgccccaggcctgtgaacggcagaaaagaccgcaaaacaagagccagtttcttagtctaaagggatgtccggattggactaaaaaattttcaaaagtcccgccctgctcccgggttggtccgttcttctagtacatgactttcattctgtatttaattggatggtggaagacgttgcttattctgtgttttttgctttactgtgacttaaaagttttgcctcttttctctttatattaatgtctgggatttcggacgctttccatgttgttggtagtcaagttgatgtctcctggaggtagtggcaacatccagccctgggaggagagtgcgtgcaggtacctttgtcctacattcctctgctgttaatttctcattcctgtggcaacgaaggaatgcatttaaaaaacagccacaacagcggcaatagcccttcctccacccaaggcaatcgtggacctagggagttttttgtgccacataacatgtagccttccgctaaactgacaggtttgagcgtatcgattttgagcgtatcgaaagcacaacttttagccagccattttgtcctcgcatgactacggttgcttatcctgtttagacagacagcaacatttaaaaatcgaagttcctttaaacgtattttgtttggcagtccaaatgtttctatgcagaaaacagtatttgtactattaactatgaagagtgtatggataaatgggagacatttctaataaaggccttcgttaatggttccctctgtttgacatccatggtgcttctgaatacagaaagcctagcgtcttatattcgcttcttttaaaatctggtgggcacattttggtgagacctaaattatggggactggggcttctggagataagctgctcaattattctaccatctccacaatgattaatatagtgagttgatttgttagtgatagtgaccacggattcatcccaagaaagagaaaggggagggaggcaagcagagagacaggaagacagaggcagggaagaaggagaaaacattctcccatggtttaagtaattttgtgttgttaattttacattacaacacggtttaacatggtgaaccctctattttggtgtaaggtttaacatatggacatatttttcccaagaccatttatgaactttcatttctgcttcccccttcttcctcccgtgccaccctccacgctcctatcaattttggctgttttgtcataggctaatacgctataatttcatggacagttggactgtcttaggtttctcaggtttctattttgttcctttagtcattcccacaattcttaaggtagaattgtattgttttaaacattgtgttgtgtgctatcctcaatgctgagatgattatgtgacaaatggcaagtgttcaactaatacctaaatctgtagtatcttatcaagcctaatgctacttcacaatgcctactccattcaccgcactttatctcattactggcattctgtcatctcacatcatcacaagtaaaacggtaagctattttgagagagatcacagtcatataattatatttatatttatttatttatttatgagacggagtttccctctgtcacccaggctggagtgctgtggcacgttctcggctcactgcaacctccgcctcacgggttcaagcgattctcctgcctccgcctcccgagtagctgagattacaggggcctgccaccatgcccggctaatttttgtatttttagtagagacggggtttcactaagttggccaggctggtctcgaactcctgacctcaggttatccgcccacctcatcctgccaaagtgcttagattacaggcgtgaaccaccgttcacagactcaaatcatttttattacagtatattgttataattgttgttttattatcagttattgctaatctcttacagtgcctgatttataaattaaattcatcattgccatgtgtatatagaaaaaaacagtgtatatacggttcagtactatctgtggtttcaggcatccactgggggtgcagtttattaaacatgcatttacattagtctcccctttgggagactaattaactgagatgttgtaacgtgactttaatagcagatagagctaattttctctcattactcttctttttcagaattttcctggttattccattttttatttttccatatgtatattaagatctcttccacctcctcctgtttctccatctcaacatcaaacaattaaaaaaaaaaaaaaaggctgggcgcggtggctcacgcctataatcccagctctttgggaggcctaggcgggtggatcacgaggtcaggagttcaagaccagcctcgccaagatggtgaaatcccgtctctactaaaagtataaaaattagccaaccatggtggcaggcgcctgtaatcccggctactcgggaggctgaggcagagaattgcttgaacccgggaggcggaggttgcagtgaggcgagaccttgcactccagcctgggtgacacagcgagactccgtcataaaaaaaaaagccggaagcagtggctcacgcctgtaattccagcactttgggaggctgagtcaggcagattacctgaggtcaggagttcaggaccagcctggccatgaaaatacagcctggccatgaaaacacacaataaattagctgggcgtggtgtcacacacctgtaatcctagctactcgggaggctgagacaggagaatcacttgaacccaggaggcagaggttgcagtgagttaagatgacgccactgcactccatctgggcgacagagccagactctctctcaaaaaactaaataaataaaaataaagttatggtacattgaacttctgtgttcctttctcccttagatactttcatggctacccatttaattgatgttcttatcatctccaagagttagtcaggagaggaatcaacccaagcaaaaatagctgattttctaattttccttcaatgccctttggggtcttaatccatttgatttatgtactttcaattaatcctaacctcgaatgtcttctgcaaacatgtttccacagatgaaactcgtcaaatgaaacacattcctttaatttatagagttaaaaattagaaaaattttcaattctatttggcctttagattcagtcttgcatatgttttctcaattttgttcatgctctttagttttgttttattccatcacaattgttcacatagcttactggcttaggtctaatgaaccattcatttggaaattaaaattggccattttaagatgaaaaagattcttgcctcaattttacttagtttttgaaactgtcaatgaggacacatgtttttctgtactcttagattcactaagtagtgtcttgcaaatttaactgacaaaggacagattaacatgcgaaaaaaaaagcatgcaattttattagtatattacatgcacagagttcccaaagaaaaaaaaattgaaaccttaaaaacgcggttagactcacagacttatacaccattccaacaaaggaaagggagtttgcacttcatgggatgacgaatttgggaatgtgacaaggaaataaatacatgggcaataaaaaccatggaagataaaatgaaagatagaaataattgtagtaaggtttgtttttgcagagtcatctcagtgccaaccttccatatctagtgataagaattgctctctttttcctggtatagcagttggggacacttttacaagggaaatttctgtcaccttcacaaagggaaatttgggtaaagagaagacagagacctcttcctacacctgttgattttcaattgccttcagctgaaaataacttttatgccaaagtagaataatttgggggtgacatcctgatattcttcaaaacttatatttaatttcacattagtaattatatcatttttgatttttaaattagttttataaaataattttgaaaaacggtaataatattcaaataattccagaaacactgctgataagccaaaaacatcaatgaatattgcataaacaactgataattcaaccatgaaaatttatgacattgttcttgtgtgataaaactatgagtaacataaaaactagaggctacttgtaatgcattattccaaactttctgttttttatttatttatttatttattttgagacatagtctctctctgtcacccaggttggagtgcaatggcgtgatcttggttcactgcagcctccacttccccggttcaagcaattctcctgcctcagcctcctgagtaactgggattacaggcacctgacaccaaacccggctaatttttttgtatttttagtagagacggggtttcgccatgtttgccaggctagtctcgaactcctgacctcagtgatccacctacctcggcctcccaaagtgctaggattacaggcgtgagccaccatgcccggcgcattattccaaactttcatacacagtgctatcatggctacaaattgaagtatcatattatacactcctaggcaaagctctggatattttggctatataagcctgagggaaatgtagtaaggacattgtggttgaaattcataccagagatgaacaggcccagtgcaagacagaattacatcactaaaggatatcagaagagaatagggatttagggtacagtggcaacaacagttttgggaactagcattttttgagcacttatttacaatatgccaagcactgttgctgattactctatatttattttcaaacacattcttgtcacagcactttgaagtaagtgccattgtcattcccacttcagggtgaaggactaaagcttggtgtcattaaggatgtagctagttagctgtgtgtgtgtgtgtgtgtgtgtgtgcatttttttttaaatttaaagtcaataaatttttatttgaagaatttcacatcaaggtaaactttgttcctctaaagagctggagtcaaaatgtatcttcaaaagattcatcttcaagttagcccttcttaatagaactgatgcttaatccacagttgtcagcccacagttcttttattttgactttttttttttttttttttgagacggagtctctcactgtcacccaggctgctgggcagtggcgtgatctcggctcgctgcaacctctgcctcccgggttcaagtgattctcctgcctcagcctccttagtagctgggaccacaggcgcatgccatcgtgctcggctaatttttgtatttttattagagacagggtttcactatgttggccaggctgatctcaaactcctgacctcatgatccgcctgccttggcctctcaaagtgctgggattacaggtgtgagccactgcacccggccttattttgccttctttaatctccatttgaacatggacatactgatgaaaactacaacattcttcaccaaaaatctttgggatttaatttcttcaaccactttactttggggtcattttaagattaggtgtatctgcctggttctcaatttgacaccctttctctctaaacatgaatgagttccaatcatatttattcctaagctatcacactcaaatatactacagatctgtggaatatgccaaaagttaaggtgaaaaattaaattattaggtatttcatagttttgctagtttttgatctgtgagtgaatataactatcctctatgtcctggcactgttcctcagaaacatagggtccacatatgtaattttaaattttttaataggcacattttaaaaagtggaaaaagaaatctattttaatgatttgaatccagtgtaaccaaaaattgtttcaacaaggtatctaatattaaaatattgagtttttactttgttattttactaggtctttgaaatctggtgtgtattttacacttaaagcacatcacagtttggagtagccacatttccaatgcttaatactcacatatggttagtggcaactatcttggacaggacagcttttatactctgggaagacacaagcaaatacttgctctgcagcagaatccagatgttttccaagaaaacactttttctgacctgttcgtgaaacccaggtagtgtctctaatactttatattttattggtttgtcctattgtaaccacccaacgggctctccttgtccacttcctagacagagctgatttatcaagacaggggaattgcaataaggagccagcgctacaggagactagagttttattattactcaaatcagtctccttgagaatttggggaccaaagtttttaaggataatttgattgtaggggaccagtgagtcgggagtgctgcttggttgggtcagagatgaaattatagggagcctaagctgtcctcttgtgctaaatcagttcctgggagtggtggggtgggggactcaagaccagataatccagtttatctatatgggtggtgccagctaatccattgtgttcagggtctgcaaaatagctcaagcattgatcttaggttttaaaatagtgattttatccccaggagcaatttgaggtttagaatcttgtagcttccagctgcatgactcctaaaccataatttataatcttgtggctaatttgttagtcctgcaaaagcagtctggtccccaggcaggaaaggggtttgtttctgaaagggctgttattgtttttgtttaaaagcaaaagtataaactaagctcctcccaaagttagttaatcccaaactcaggaatgaaaaggacagcttggaggttagacgttagatggagtcggttaggtaagatctctttcactgtaataattttctcagttatgatttttgcaaaggcagtttcactgtccacttcacctcacatcaggcctctgactagaggattccaacaatacttaggccaggacaccaccatgtctccttatccaccctgagggattccaatttctgaaacaaaggaaactatatatgatagtatgaaactatatatgagaaggaaattatatatgataatcaattttagggttatcttattgattagaagatattaaagtgtgacactgcctggcaatgatatctgctggtagtaagaatttggcgaatttagtgaaattcctgaggctgaacctccacttctgtaaaatggagacagtgagataatttgccttacaatgctgaagtaagaattttacacaataattcagaccaaccacttcatgtggtacttggcccgtggaagactatcaatgacagttagtttatagtttatactattaatgaatcctttgtttcattgttatttccttctacacgttggcctctctaaaagaaggtaatattcaatacaaataaagttaaaacagcttgcagagttgtcccagggaactcacttaaccactgaagtgttcaaattgcttaaggttgactttatattctcctgactaacctttctccttctggtatttcttctgagaacagcaccaccatccaaagcatcatgcaaacagtggtcatcccagaccagtaattctcaactcacagggtgctcctgcagagatgtatttgaatagagtggtaggatgctgaagaaggccacgtaaaatttggccagtgatctggggcagatttatcctgaagctaatgaaacacaagtgtaagggcctgtacttccaaggtgcagagaggggccctacaaatgtgttagtttgtctctctctctctctctgattttaaaatttgcagtattaaggtactttaatcacggatggttcaggctgctattttcactcaatcctcctttttattaaaatcaccattgtctgattatgttagaatcctgatgaaaatatttggaatttgagtaagagaaagtttagttgaagatgtatctagtatggggataataagttacgtgatttgcatatgtgatcatgtgtacttcattcgttgccagccaatctgacgtaagaatggcttcaaggaggccgggcgcggtggctcacgcctgtaatcctagcactttgggaggccgagacgggcggatcacgaggtcaggagatcgagaccatcttggctaacacggtgaaaccccgtttctactaaaaatacaaaaaattagccgggcgtgttggcgggcgcctgtagtcccagctacttgggaggctgaggcaggagaatggcatgaacctgggaggcggagcttgcagtgagccgagatcgcgccactgcactccaacctgggagacacagcgagactccgtctcaaaaaaaaaaaaaaaagaatggcttcaaggaatgttcctactgctcactggaataactcacctaaattcctggcaagatgcaggtctagataaaatgttatgacatctaagtattcaaaacacattcccagcactgagagtgagtgtctagtggagagtagaaacgtatagagccagaagctagtctggaaagaattcttacaaagtttacaacttacatgtgaaaggagcttaacagaggattttccaaatttgaaaacaatcctaaaaacttacttgacattaccaataatgtgttttgaaactgaaatacttctaagttatgaagaaaacatattatcatcagccaccctggaggaaagattgaattctatttccattacctatagacaacattacaaaataatttcgatctgaagatggaatcagagtattcagtcaaaactacaggaaaatatacttggtagtgtcatattcagaagttaataaaatatgctattttctgaattttgtgatggctgttgttttgtcagcttttataaaattggaatttgattttattttcccattataaatttatatttacagtctgcagtacttttgcatttttaattttacattatagcttttaatagttaacaagttgtaaaaggtttgatccccagaaaaccttgatctaccccctcagttaagtatactaatatatttagaaaatggatgaaatcagcatttgaatatttttaaatatttattaaaagaggacatgggtaaaagagctttgcagttgccacccttcattctcaaattccctggataaggatgaccgcataatctttggatggtcatacgcaagtcttgtgtatttgttacataaatctatttagtggacttttggcagtgtgtactgaggccagtttcttccacctgagctctgactccacctccagcagcccaaaaccaatactgaattttggggtcagctattgtttttgtggacttaggtaactacacacacattgtctttatgatagctttaataatactgccatcagaactaaaattgtcacgtggattaaaaggagtgacggtggtgtccccaggagcctttcaatatgtaagtatttacacatatacatgctaaaaagacccctaggaatttttttaacaagggcaaaacagtaactcagcttgttttctcgcagtaaaaccggttgaaaaggcctgatagacttgtctgcagttacaaaacttgtgtgtagttatcacctttatatctcctggaaactaacatagacaaccgaatgggttacaactgtttttaagtgaaattgtgagtggctctgaaaagagccttttcaatgaggaagaaacgggcagacttatgccctttccccacggatgcgacgtgccagctggatatctttgggcatgatggtgacgcgtttagcgtgaatagcgcacagattggtgtcttcgaagagtcccaccaggtaggcctcgcaagcctcctgcagcgccatcaccgcagagctctggaaacgcaggtcggttttgaagtcctgggcgatttctcgcaccaggcgctggaacggcagcttccggatcagcagctcggtggacttctggtagcgacggatttcgcgcaaggccacggtgcccgggcggtagcgatgaggtttcttcacgccaccggtggccggagcgctcttacgggctgctttagtagcaagctgcttgcgcggagctttgccgccggtagacttgcgagctgtttgcttcgtacgagccatttgcaatgagagcacacacaaaagtgtagtgaactgagagcaagtggcctttaaatatagtgagaaacattctgattggtcctgtaatatttcaaaagtcccgcgcgataaaatcattggctgaagagtgaccagactgattggttcattactagacaatcttattggatgagttgccccaccgcccatcctgtccttttcgtttcagttatctgcagcgacaaattgtctaaaattctagttcatccagtcccaaagaacagagtgtataacaaggtatctaaggatttttaaaatgtaaattccgattcagtaagtttgagtgggacttgaaattctgcattcctgacagtctcgcaagttatcaatgctggtgaacactcactaaaccaccagaaacgttcagactcatgtcgggaaataacgcttatattcagagaatgagattccatgctattttgttactggcgaacagcaagtttccttgccctttgttttctaagtccaagtcacattcccaccctgcctgttctcaaaatgtcttattttggttggccttaagtttcactttgtatactctaaaatgtactttctaaaggaaggtgttattttctcgaaacttaactttttaacaccattaggctaggggggcggtggctcacgcctgtaatcccagcattttgggagggcgagatgggacgatcactagaggccaggagttcaagacaaccctggctaaaatggtgaaaccccgtctcgcataaaaatacaaaaactagctgggcgcggtagcagacgcctgtaatcccaagtacacaggaggctgtggcatgagaaccgcgtgaagcggcggggtggaggttgcagtaagccgatatcgcgccgctgcactccagcctgggtgacagagctagactgtctcaaaacaaaccaatccaaacgaaaagcaaaaaataccctaacagaagcaagttatcatcctttcttgtgtaactatggacggctctgaaaaatgccgtttcaagtgtaagctacgttttctgatttgagtgtttacttgaccttggccttatcgtggctctgttattttggcaacaggacggcctgaatattggacaggacgcctccctgagcaatagtgacgttgcccagctgcttgttgacctcctcgtcgtttcggatggccagctgcaggtggcgggggatgatgctgcgggtcttgtcacgtatggcgctgcccaccagttctaagatctcggcggccaggtactgtaagtacactggcgcaccggctccgaccggctcaaaataattgccctttcgaaaaagatgacggactctgccctattgggaactgcaagcccggtagcgacgaacaagtttttgctttagctccattttccacgtccgcaaatagcgacctatgaaagcagcggaaaactgtgaaagacaagcaagctggaatggcgcctgaacaaatccttttatacaaactgcaaggctgcaataggaagctatcctattggtcaattatgtttggtgctttatccaatagaaaaagataacataaattccatatttgcataaaccccacccctcagtgaaaccgtgtttcttttgtccaatcagaagtgaggaatcttaaaccgtcatttgaatctcaggactataaatacatgggctctgaactgttctctgtactactctgtagtggagagtgttagtagcttttctattctgtttaggaatagcaatgcctgaaccctctaagtctgctccagcccctaaaaagggttctaagaaggctatcactaaggcgcagaagaaggatggtaagaagcgtaagcgcagccgcaaggagagctattctatctatgtgtacaaggttctgaagcaggtccaccccgacaccggcatctcatccaaggccatggggatcatgaattccttcgtcaacgacatcttcgagcgcatcgcgggcgaggcttctcgcctggctcactacaataagcgctcgaccatcacctccagggagattcagacggctgtgcgcctgctgctgcctggggagctggctaagcatgctgtgtccgagggcactaaggcagttaccaagtacactagctctaaataagtgcttatgtaagcacttccaaacccaaaggctcttttcagagccacctactttgtcacaaggagagctataaccacaatttcttaaggtggtgctgctgctattctgtttcagttctagaggatcaactggaatgttagcgaagacaagttttagagccaaggttaacttggacggggccgtgcgcggtgcctcttgcctttaatcccggcaatttgggaggccgaggcgggcggatcacttgaggtcgggagttcgagactagcccggccaacatggcgaaagcccgtctctactaaaatacaaatgatagacggtcgtgatggcgctctttctcatctgtcttagcaaacttctttgttccccctgggtaagccttcgggtactatgtataattcctttgataaggtcactactccctccctggtctagtacaggaaacttccctttctggataatgaagcaggtaatggaattcagggtatagtgttcctgtgggggtcattagccgttaacttcttgtgagatgcgggggaggggagcagaaaagtctaagcgacaaaagggcatgtagggatatttgctcctgcagcttgcctatgctgtaaattcttacttcaagtattgaggaaacaataagcgaagtctgatttcccgggcgcctttatacggaatatttcccgctccacaaaatgaaatcgcagtagttttgagttataattgtttatcaatgacaacagctatgtagtttacatatttcatgcatcccagaaatccagattcccatttcctaagccacttaacgttctgatttccagctctgcgagatacaaaagggtttggattttgtgcccttccccatctggcgccactgcaaagcttactaggagggccccacttggagagggaaatctttttcgagaagtccaggacgccaaaaacaatatagctaaaaaaaaaaaaaaaaaaaaggcaggaagagcactagttgaggaggaggactcaatgggccaattctggggctggggctgggggaagaaatgcaagaagaaaagacacttgttgactgcacagtaagcaggagggggtgggggaatcggaggggagtattttcagcgaatttatgggcattatatgtaggtgacatacagcagtgtctttggatgaagaaataaagtttctcaaacagttcttgtttttgttttgagaaagggcctttctctgtcggccaggcgccatcatagctcactgcaacctcgacttccccagctcaagcgatcctcttacttcagccccttgagtggctgggactagagaaatgcaccaccatacccagttaattttttaattttttgtggaggcaaagggtcttactttgttgcccaggctggtcaagcgaactcctgggctcaaatgatcctcccgccttggcctcccaaagtcctgggattataggaatgagtcaccgcgcccggcccagatttaatttttaagaatcttttaaaagaggttctgggccgggtgtggtgcagctcacgcctgtaataccagcattttgggaggccaaggtgggaggatcacttgagcccaggagctcaagaccagtctgggcaacttagtgagaccttttgtctccaccaaaaatttaaaaaattaaccaggcctggtggcacatttctgtagtcccaagtactggggaggctgaagtgggaggatcatttgagcctggaaggtggaggttgcagtaagctgtgacggcacaactgcactccagtctgggtgaggacagaccctgtctcaaaaataaaaaataaaaaaaaatctggatgccacacaaaatgtcagtgaacaactgtaagtgaagcacttcccatcctagtactgtatatgcaaactgccgttgtgaaagtgacgcttggcttaaaaatctacattctttttttaattataaaactaccacatcccccaaaaacattactaaggaattgaggctgcagtttaagaagctgatatttaggatctatctccggagaagtgagacctggtaatataagcattttcaaaatgaacttttgggccaggtgaggtgtgtcatgcctgtaatcccagcactttgggagacctagtcaggcagatcacttgagctcacaattcgagaccagcctgagcaacatggcgaaatccagtctctacaaaaaattagcagggcgtggtggcatatgcctatagttccagctactatagaggctgaggtgggaggattacttgagcccgggaggcagaggttgcagcaagccaagatcgcgccgccacagcctgagcgacagaatgagatatgcacccacgccctaaaaaaaagcatgactcattaaaaaaaaaaaatttagccggtcgcggtggctcacgcctgtaatcccagcactttgggaggccgaggcgggcggatcacgaggtcaggagatggagaccatcctgcttaacacgatgaaaccccgtctctactaaaaatacaaaataattagctgggcgtgatggtgggcgcctgtagtcccagctactcgggaggctgaggcaggagaatggcgtgaacgcgggaggcggagcttgcagtgagccgagatcgcgccacggcactccagcctgggtgacagagcgagactccgtctcaaaaaaaaaaaaaaaaaaaaaattaaaaaaatatgaagttttgaagcagaaattattttgtcgtatgttctttcataaattttttgcctgcctgccttcttcctttgttacagaactccaacacttacccaaaggtagctgttgggtcagggtttctgtactatagtcccttctgtggtggccagaaatatgttacaggaaagaggtccccatccagaccccaagagagggttcttggatcccgcgcaagaaagagttcagggtgagtccgcagtgcaaagtaaatgcaagtttactaagaaagtaaagtggtgaaacgacaactactccatagacagagcaggacattcccgaaagtaagaggaggaaggcatccaccctaggtacaatacttgtatatatggggagatgtgctctgctacaagtttgtgataaaggattaattttcttagttactatattttgcaagaatcaacattattatctttaaacaaaattaagaatgcctttgttctccagatatagggatatctggacactcctaagtctgagtctgtttagtaaacattatttatttgttcccttaaccgtaaacatctagaagctaggaatgactgactttctgggaatgcagcccagaaagtctcagcctcattttcctagccctcactcaaaatggagttactctggttcaagtaactctgacacttttcttctctttttttcttcttttttccttcctttattttttattttttatttttgaaataagaaatcaagaatacttgatgtttcatctaaaacaatacccataattgataagccaaaacaaaaacctaggtcttctaactcaaaactaggatgttttgctgtctctgctgatactcggctgatcgttaataggtaattaacaaacaagccttgctatgtccccctcagtttattaccattagatcatatgcctactgtcaatcatattaatccacaactatgcatttcacaaaacttgccataaaaattcacaggtttcccgcttccctcgagttttcatttccgaagggtcccatgtaatataaaacttatattaaatacatttgtatgcttttctcttgctaatctttttttttgttttttgagactgagccttgctctgtcacccaggctggagtgcaatggcgcgatctcggctcactgcaacctccgcttcccaggttcaagcgattctactgcctcgccctcccgagtagctgggaccacagatacgtgccaccatgccccgctaatttttgtatttttagtagagacagggtttcaccgtgttggccaggatgttctcaatctccttacctcgtgatccgcccgcctcgtcctgccaaagtgctcggattacagacgtgagccactgcacccgaccaatctgtctttttgtagaggggcctcaagcatgaacttactgatgggtgagaaaaacagaattttcttttcccctacaatataaacattaattgtaatgttatcattcaggacattttggtgaccaatcttacagaaattttatcttgtgcaagtctatgcaaaccaatatgtaaatcttctataagtgagattgtatttcacttttctagtatccttttaaattaataaaagagattctaatgattattttcattactgcatttcattgtagggaagtagataattgccctttattcactgaccttcgctttttaaaaatttaaaccatgttaccatgaaaatgcttttcagtatttctctacacacaagattgctgtaagggcaaaaatagagataggaatcatgcatccattgatatacatattttgatttttaatacatgttaccaagttgcctcctgaaggtctgtttacactctcaccaacagggtgttttttcctgacttccacaaatgctcttgaacagtgggtgtgttagtctgttcaaattgccgacatgaacaattaaatctcattgttgtttttatttttaagacaattattgtttgagactgcacattttgataataacatttcttctattatggtttgattactcatgattcttgcccattttcttttgggatgttgccttatgtacattattttaaatagatagctccatgtattaaaagattattaagtttgagggcttatgatatgtcagttacatttctaagatttttttttttttttttttgagacggagtttcacacttgttgcccaggctggagtgcaatggtgcgatctcggctcaccgcaacctccgcctccagggttcaagcaattctcctgcctcagcctccccagtaattgggactactggcaagcgccaccacgcctggctaattttgtatttttattagagatgaggtttctccatgttggtcagactggtctcgaactgccgacctcaggtgatccacccgcctcggcctcccaaagtgctgggattacaggtatgagccactgggcccggccacatttctaaattctttataagtataaattcattcaatcttcaccaaaactcaatgaagtgtgagtactattattatcattgttttacagatcaaaacaagtaatacagtcacttactgagttctatacacctggtaatttttttgtttcgttgttctatcaattattggggaaggggtgttgaaatctctacctttaaatcatgtatgtgtctatttctcctttcggttctatcaggttttgctacacatattttgcagttctgttatttggtgcatatacatttagaattgcttgtttttcgtattggattgaccctgttatcattatgtaatatccctgtctgttcctagtaattttctttgctctgaaatatacttatctgatatatcatccaaaagaccaccaggatggctaaagagtagaaaggagagatttactggcaatactaatttgcaagccaggaagagatggtcccagaacctgccaaaattactctctctttggggagaaggagcaggttggttatttttatgcctcataggctatatattacacaatagagtcatacatatttagcacgtttggggggacagctatatatattatgaggggtgccaagtgcattcacaatggataaacacgtgtaatatacctcccatgttcacttcgaggttaaattttggttaaaatgaggtagaatttaggtctttacatcacaaggtgaactataggaacaaagtttacgtgctgcctctagcagctggctgaaaatggcttaaggtctacaattacgtgtaagaatagaatgtgtgtcaaggcggtcctctgtccaatcagagttgtagtggactggactgtaaatcagagttaggagggcttctgatagctcctatagttaaggaatttagcaagtgtgagttttttggtagtctttggaatttaggaatttgccatgccagccaagccatgaatgctctaccagtaggtaactttgtttgcttaatcttagagtctgtcttagttggtataggggcatctattttggtctttcagatcccagatattattaatacagatactcttgcagttttgggctgatgtttatatggcttatcttttttgcagcctttaatttcaacctgcgttatgtttatatttgaagtgagattcttgcagacagtgtacagttgttgttttttttttttttgagatggaatttcactcttgttgtccaggctggggtgcagtggcacagtctcagctcactgcaacctccgcctcctgggttcaagggattctcctgcctcagcctcttgagcagctgggattgcagccatgcgccaccacacccggctaatttttgtatttttagtagagacaggattcaccatgttgcccaggctggtctcgaactcctgacctcaagtgatccgccagcctcggcctaccaaagtgctgggattacaggtgtgagacctcgcgcccagccaaactgtttttttatgggtgtatttataccacacacatttaatgcaattattgatatcttagggcttaagttcatgaagggtagtgtgggaaccatagtctcttggcccactaaatgtttgccagaaatcactgacaaggcagattgattaataggtgaaaaggcattttacctattgtttaacgtgtctatgtgggagcattcagaattaattacctaacttcccaatgagttatagatgcttatataccatttttagatcacagaaagaattggggcttagattctggtaaaacaggttatgggaggcaaaagaggtttggcttgcaaaggtggccttgttaggtaggtgaagcctccctcagaaagaacagatggtaaatgtttcttttatgatttttaagtgtcagactctcagtctctcctggatctggggaaaggtatagaaaggtgaggaggcatggctgcattaatggagattctctacagatgtaaaatttttcccatttaaggcagctttgcaagcccatttctgcctgctggccaagcagcagccatttcaaaatatgtcaaagaaatatattttggggtaaaatattttgatttcctttagactggtggccttataagaaaaggaagagacacctgagctgacacacatacccttgctctctcaacatgttatgatgcagtaagaaggccctcaccagatactaattccatgcccttagcttcccaggttctagaacagtaggaaataaatttcttttctttaaaagttagccagtctgtggtattctgttatagtatcacaaaatggactaagtaactatattatgatcatcttacatgactgatccctcctacatcatacacatacacaggccacatttggaacattgttagaggttcctctacccagtacaaatgtactacaaattatatatgtatttttaaatttttgagtatcttcaatagtatattttcgttaacttttgtagtcaaaatgtcattataacatgtattcaatatgcataattattagtcagatgttttacattctttcttcatactaagtgatatggtttggatatttgtcccctctaaatctcatgttgaaatgtaatctccaatgttggaagtgaagcctggtgaaaggtttttggatcgtgagggtgaacccctcatgaagcgcactcttcagggtaatcaatgggttctcactttgagttcacaagagatctggttctttaaaagagtgtgacacctcccccatctctctcgctcagctctcaccatatgatatgcctactccctcttcaccttccaccatgattggaagtttcctgaggacttgccagtagcagatgcctgcaccacacctcctgtacagcctgcacaaccgtgagccaaaaaaaattacttttctttataaattagtcagtttcagggattcccttatagtaatgcaagaacgaactaacacactaagtctatttcatatttacagaatagctcaatctgaagtaccctttttcaacttcacagtagctacttgtagctagtgggcactgatttggagcgtgttcaagggtgaattgtattatgcaattaacagattttttttattgttttcgcaaaccacgaggcatagattgtcttactttctctgctcctggtgttggagttgttattgggaaacaacttattttcctcttatatttatatggaataaataacccccaatatttccctccccaatatctgccttttgtatgttttttgaaggcaagtgcctagaatttactgtttttgaagcacttactgaaaggattgccatcaagttgttttgctaatagtacatgccaggcgcttgttggtttgcttaattcaaggtaacttggatgagaagaagagtttttctcatccatggctcagtggagtatagattactgatattgtgactggatgtactcctgctttctagtctgagtttttgaagctacccttaatcttggtttcaattttatctagccctgtacatatccaaggctctttccaaaatggtctacgatttgtttaggaagttagaatagctgtactttctgaaccacggttcctgacattttctggacttcaaacacatccagcattttatcgaagtatttatccttcctacttggctggcttcttccttgccttcaggtctgaattcaaatgacattctcctgatgaaactttccatccttatttctattcttttttcttatcccctttctttatttttctccacagcactcatcacttatctctacattttcattatgtatttaccttattgtgcacctcccactacaagacaagtagcaccgtaaggaaacaggttgtctgctttttcactgctatgctccctgcacctagaacactctctggcacttagcaggttttcagtaaatatatgctgaactaataatgctggatatacatctccctcatgaactctctaaatccttctaatttacattgatcaatcttcttttccatgtgcttttgtatgatttattgctcaaaatctttattttgtatgcagaacgtgcactgctatttaatcttcatgtacgtaagtcctcccttctctgagtataatctcttcagggcactatctgagataactttttaacatctccatcatgaatcttgtaccttttcaaagaaaatgagccagtgattactgatgtttacggctattgttgagggtgaagatcattataattttgaaaagggaagttgaatattgtgaagggaaagataacactagagtcagaagacttgggagaaggcaaaaaacaaactaaaaatgagcacttttagtctcctgacagtttctctgaatcaaatccatagttctgtgacagcgttggcttagaagcagatttttttttttttttttttgaaatggagtttcgctcttgcccaggctggagtgcagtggcacgatctcggctcactgcaacctctgtctccagggttcaagcgattctcctgcttcagcctatggagtagctgggattacaggctcccacaaccacgcccagctaattttttgtatttttagtgaagactggggtttcaccatgttggccaggctggttacgaactcctgttctcaagtgatctgcccgccttggcctcccaaagtgttgggattacaggcatcagccaccgtgcccagccaggagcagatttttttacactcatgtttctttttccttctgtcatcctgtttcagtataagcagaccacagatagaagtagtagatacctcagaaattcctggaataattaatccacgttcatctgtactccatctgctcctatctcatggaatataaaaggaaaaacaccaagatttccctaggcaatctgtcttgattttaggttcctcaacaggagagccagacaatggctgtaataatattgtcccggccaaggaaaaacttcccctttgccctcccaaggtttatggaaaattactggcaaaacacagattaactggagaaaaggcatatatatttatttcatcacaattttacaggagattttagaattaagactgaaagatacaggggaaattgcccatttttatgcttaggttcaacaagataaacagctgtatagggtacgatctaatgctaacagactgagtggggaagccccgcaaggcttgtctgtcaagattcttcttgacctctcagtgcagcatttcttccttctggttataggacaagactctcttttagaatggggggtcttatgacctacaggcaaacaaggtaggttagagtaatatttttaggttttatggctggttctagggaaaaggagttctggtttgtatggcctaccttgaggaggaattctggtttctatggctagactttggggagaatgggacttacagacaggaaggcagaaggtggtcagtgaaacacttttataatcataatcccattttgagtatttctgtgttatggaatgtttgttctctcatttcctgaaagattccagagactcctcattcagtgttgtgaaaaagttcaggaaatgcaactcaaaaatgtgccactttgttacgctgatttctttgaactgagggcacctaggaaacagtaaattcaaggaagggctttcgctgaactctaatcaaaaatttgaaaattaaaaaaaaattcaaaaaggaatttagttgttaagattcacttccctggggaatctcatcaaccagagaagattaactgtatcacaggagaggagactggtggttaacaccatctaaacagactttgtcacagctgtcacctattctttgaaacacccatttatttttctccaaaatcatatactctcccctaagttgcctacatcccccttctttctcccttatgaatcaagagagcttataagcttctacagttcactgggatttggggtattcgcttttcttccctcccactccccctcccctttttttgtctttgagacacagtcttctggctctgtcgcccacgctggagtgtggtggctctatgtgaactcactgcaacctcctcctctcgggttcaagcgatcctcccacctcagcttctcgagtaactggaactacaggcgtgcactaccaagcccggctttttttttttctttttctcccccgtttcttttttggttattttactggagacagggtttctccatgttgtccacgctggtctcgaacgcctgacccgccgtcctcggcctcccaaagtgctggtattacgggcatgagccactgcgcccgatttgaaggacctcttaaatatctatttagaaattggtcggagtccactcctttccaaaaacatgagtcacaatccgggaaaagcacgagcggctgaaagtcaaaataaccagaacaaaacctccactcatgcttaaaaaaggtattttgacaaaatcctaattcggccaattattattagtattcaagtcgaaggctcgtcaagccagactggggattgggtcaaacataaaccttacaccagacggaaggattacatgcaaatgaaggatgcagattctgatttcccattgggtatttgacattagccaatgggagaattcctcacagcctacctccagtcagtataaatacttctctgccttgcgttctaatgtagtttcattacattttcttgtggcgattttcccttcttatcagaagtagttatgtctggtcgcggcaaacaaggcggtaaagctcgcgccaaggctaagactcggtcttctcgtgcaggtttgcagtttcctgtgggccgagtgcaccgcctgctccgcaaaggcaactactccgagcgcgtcggggctggcgcgccggtgtatctcgcggcggtgcttgagtacctgaccgccgagatcctggagctggcgggcaatgcggcccgcgacaacaagaagacccgcatcatcccgcgccacctgcaattggccatccgcaatgacgaggagcttaataaacttttggggcgtgtgaccatcgcgcagggtggcgttttgcctaatattcaggcggtgctgctgcctaagaaaactgagagccatcataaggccaagggaaagtgaagagttaacgcttcatgcactgctgtttttctgtcagcagacaaaatcagcctaacagcaaaggctcttttcagagccacctacgacttccattaaatgagctgttgtgctttggattatgccgcccataaagatgtttttgaggtgtttttaatggctttgagtgtggcacttttagtaatttgtcctgcagaaattagatccatagaaacctcaggaattctaggtatgtgggagaagtgccatgcagcacaaaacatgtttacaggggtgattcgcgttaagtttcacacacagcagttactacattttagaggaaggaaattatacccatgagtgcattcctaactatcttgaatggaagtgttaaaacccgcatgccccacacaagtttgaatatgtcataccatttgctgtagcaattaatggcatacacaattgagagcacacacattaccactgaacatttgagtatgtatttcccaaaatgagcttttttccagtttggggatgttttgctttgttttggggtggagtctccctctcgcccaagctggagtgcagcggcgtgataacagctcactgtaacctcgaactcgggctcaagcgatcctcttgacagccttctgagtagctgggattacaggcgagagccgccacgcccggctaagagcatttttctaattgcccacacttcttatgcgacacccagaaaaatacaattttaaataaagcgcatatgcaaatttccctaatcgtctccaatattctctgatttcttttttatattttaactagaaacaattggaggtttccgcgttgctttgtgtggttgtaaattttaagacttcaggaaacttttccagtacaagacttgtccacagtggatatagcagctaaggggttaacaaaatgacgtcagagtagctacggtaatgggcaggagcctctcttaatctgcaaccaggcacagagatggaccaatccaagaagggcgcggggatttttgaattttcttgggtccaatagttggtggtctgactctataaaagaagagtagctctttcctttcctccacagacgtctctgcaggcaagcttttctgtggttttgccatggctcgtactaaacagacagctcggaaatccaccggcggtaaagcgccacgcaagcagctggctaccaaggctgctcgcaagagcgcgccggctaccggcggcgtgaaaaagcctcaccgttaccgcccgggcactgtggctctgcgcgagatccgccgctaccaaaagtcgaccgagttgctgattcggaagctgccgttccagcgcctggtgcgagaaatcgcccaagacttcaagaccgatcttcgcttccagagctctgcggtgatggcgctgcaggaggcttgtgaggcctacttggtagggctctttgaggacacaaacctttgcgccatccatgctaagcgagtgactattatgcccaaagacatccagctcgctcgccgcattcgcggagaaagagcgtaaatgtaaagttactttttcatcagtcttaaaacccaaaggctcttttcagagccacccacttattccaacgaaagtagctgtgataattttttgttgtcttaacagaacaaatttctaaggacccccccggaaagcattagactatggtcttaaagttgattaacagaaataacggtttggtcagtcttgcagtgtaggttatttctgaccttattaaggtgctatttggagagaagctgtgtaagtccactatcattcaggcctctagcttgctatgattagcatttgtttaaacaactttgtaagagtaagggaaaaatctggtaagtagttaactggcgcttactaggcatttttgcaaagctttgaaaagattagaaaattgtgtcttgcgagttccagtgtcttcctcaaaatgcttaggaagattttctcagctcaatacatagtcccctaggttttctcatatattatatatatatatatatatatatatatatatatatatatactgttaaattcatttggctgttaacattaacctgaaatttattctggtgcaaaatgtgaggcagggatctaactggctctcattttatccatagctagctacccactttaaatctgtcagtctgtcgaccaagcataatttaatcccttatatatgaatttttatatgtgtggctttgcttgtaaatagtctatctggttgcattgctttgtctcctctaggactatgcaccatgacatgccacattctttttttcagtacttcttgcctgtagttattaaaatctagaatttacaagttttaaccattttctttctgttgatcttgcttttcggttttggaggttggggattgagtactggaagaaaatttagagggatgggaatactgtacgcaaacaaaagtaatatttactttaaaatttttatattttgtatttttttatcatatagcttttacatcacattttacagactaactttagaacaaccacagaatgtccaacattaaaactactaattccaaagaccttgcctcacattcttttttacaataaatattttttacacctaacattctttcttggcctacatctagaatgtaaactgatgtaccatactaaaatcgcctgaccaactgtcaacaacaacaaatcacacacacaaaagatcaaatttgaattgcatcgtttacttaaattcatttgtgttccagcttttaataaggcagtttttggtttataaagtaatatttgcattttaaaaattatgaaaatgaatatgtcagtttgttttatgattcgtttttcttgactcttatacaagcgactctaactggcatagacatttgttatccacagacagtatagatatgttagagatgccaatggacttggtctatgccaaggtgactactcacaagctctgggcccagctgaaggtcaagtattttttttccagttatagatgtgctggatctgatgtatagcgcttgactttttatattttctttatctgtaggaaacaaatgtgttggaggtactgggtctgacgaatagcataaaagaataaagttacattactgtctgaggatcagatggacagggggtggtagctcagtccagctattttccactccctcacttacattctttgccccctcctcaacagaacaaggattctgctgtaactcttcattgacagttgatatttaaaaattaacgaatggatgaaattctcatttgtgaaagaaaatttattgagcattttgtatttgtgagtagtgcaaacattttaatattatattaagaatctattgttttgtattagaggagtaattaaggagagattggagacaaaaagggggtgttgtttgcagaatataccatccaaaaatagaccactgtgggatcaggattcttttgagctaaaggcacttcaaaaacagcattcaagaagggaattcttctaaacttttctttctgaaaacaggagataaaagttccaatgtgaaaaatgctctgcttgtaccaggtgaaaagacatattcttcagcccagaggcatagatgagataattctgcacaaacacagcagggagtcatagccgagagacttctatacacaaacaaaccttgttaaaataatcatatattcctttaatctcctcatatggtttactttcccacaattgcctctctttaacttaatgtgaaagcatttagcttttgccatttctttggggcttcacttttttatgagggttctcctgtcccataaaatttacattaaatacatttgtatgctttcattctgctaatctgttttatggcaaatgaattatcaggtccagctggagaccctaacagagtagaggtaaaattttgcctccctacaagatagagattgtgtgcattaaatgttgtttgttcccagttgttcagtttgtcaggcctctgagccgaagctaagccatcatatcccctgtgaactgcacgtatgcctctagatggcctgaagtaactgaagaaacacaaaagaagtgaaaatgccctgttcctgccttaactgatgacattaccttgtgaaattccttctcctggctcatcctgactcaaaagctcccccactgagcaccttgtgacccccacccctgccagccagagaacaaccccctttgactgtaattttccactatctacccaaatcttataaaacggacccaccccatctcccttcgctgactcttttcggactcagcccgcctgcacccaggtagaataaacagccttgttgctcacacaaaccctgtttgatggtctcttcacacggacgcgcctgaaacagtttaacagggtttttcctgcccagtcacaacaaagtgatgttatgctgcaggctgaagtttacagctaatgctgttgaagtctaaaatcagttttggtttgttagatttgggtgagatggctaagattctcagagaaagaagtcaagtttggggtgcatttttcagacttaaaaatttagcagtagcccttgcagtttttccaatagaagtgatttacgaatgttttcaggaaatttaaaacaacagtgagaagcgtgtatggagagttgaactacactccagacttggctataggaaagcacgaatgctgctattgtattgcaccttggaaaagagaacaaaggaatattttcggacaattttaacatgtcacatatgaaaagctaaacggaatctgtcaacaccttgtacgttattacaggctgtgattttaaaaaaacaatccttactaatacatacatagttgctgctagcaatatagtgttgggagtaaaaacacgaaaatgagagttcaggacaatatcccaactctgagcagatttttttaagtagtaacatctaaaattaaaccatattatgtaatatttatttcttttccacagtctcttctcatgcctcgttcacattagctaattaaaagtcccctgagtatcatcataacccgatttacagatgaaggcacggttgcaatgagctatcaccctcttctgaatgagacagtacagtgtgaaggatagcaaaactccactcccatcctcttagggctctggctggaccagcaaattaaattaatgtaaaatggattaacaggagaaaggtatatgcatttatttaacacaggttttacgtgacacaggtgctctcataaggtaatgaaagcccaaaaaaagcagttagctacttatataatgaattggacaattagtaaaatgtaaaaatgcgctaaagcaaagggatttaggctagaatatataactgtgtagagaagcgcccagcaagggctagtgcaaggtttgtacagaattctcttggcctcagcctcctatccttgagaagaatgttgctttttttaaactacagtgagaacatctttcatatgagaatttcacctactgcttctaagaaacaggtcagctttcaagaaaacataaggccagagtgatcttttcacgcctgctcttttaagtacctttgaatagtcaatatgtcttcaagcacttgaaagacttaaaaagtttaccactccggcatattagtgaaagcccttaatataagcccttattaaaattctcagtcgagggtataaattcagattcaaatagtagtgtcgtaaacgggagggaaaaactaaagggattaaaaagtgaaactattgtgttctccctcgcagtccttaggtcactgcccctcgaggggcggagcaaaaagtgaggcagcaacgcctccttatcctcgctcccgctttcagttctcaataaggtccgatgttcgtgtataaatgctcgtggcttgctttcttttcgcgtacctggtttttgttgtcagctggttagacatgtctggtcgcggcaaaggcggtaaaggtttgggtaagggaggtgctaagcgtcaccgaaaagtgctgcgggataacatccaaggcatcaccaaaccggccattcggcgccttgctaggcgtggtggggttaagcgaatttccggtttgatttatgaggagactcgtggcgttctcaaggtgtttctggagaacgtgatccgggacgccgtgacctacacggagcacgccaagcgcaagactgtcactgccatggatgtggtttacgcgctcaagcgtcaaggacgcactctgtacggcttcggcggttaatcttttcgtcagttttcttccaatggccctttttagggccgcccactccctctcagaaagagctgtgattgtattctttcggatggtaacatctcaatggctttactcggctattctgcctagtatgtagaactattataaaccagttgggagagaccaggttgtttggtctgagtggctgctaaagcagaaatcagctaagtaaacgaggtctccgagataagtgagctataaacttcaatgctatagttttgacatgtcaagcaacttaacgtgcagcgcgagtccgataaatgagtagctcagctttttagttttaaaaacgagttgtgcgttatttgtacgagagcctaagatgctagctgcctggaactgagtaggtggattaaaatgggtgtcaggtctgttttcccaggcgtatctgacttaacgtcagcaaaagctgtacttttagcttccctggtaacacctgccgtccttaaccgccccctgccggtagcgccagaagcctttacttccatttctagttgagcttggcgtcctgctgagtgacgtcacctcccccttctgtggagtaggactggcggttaaagctgctttgctattttcagtcctcaggctggaggctcccctaagcaggctgcctacgcagttcgtaaattcccacttagtagactaagggagtctgttttataaataaggactcaaatttcttctgactccgaggtccgtggcagcagctataagatggaagccccctctgatgtaagattctcagatgacttgcatcttcactgtacctgtcaacccaatagtcttctattcctgccttaaattgtaaattccaaaactgatttaattgtgaaagtttcaaactgtacgacctaggaagtgtcaaagttaggtgaccagatttttagaagtcagccaaatattcagcatctttgatttagtaacaaatatattgatggctacttcagcaaaaaaaatcaactttgttttctggttactttgctaacaagcttctcctgacaggaggatatagtgaataggcagttgaataagtgagttcgggtgagaggtctgagctggagataaaaatgtgtgagtcatcagcagataaataaatgctgagaccagatgagatggctaaaaactgaaacataatgtagtgcagcattgtttgtaatagtaaatgagtggcaactgtaaagttttcatcagaaaggactagagtgatctatacatccataaaatagagtatttctctacacagccctactaaagaatgagaaagctgtactccactacatactctggtgtactctggctcagttcttggactcctcttttcttggctaactcaactggcctcaccacttacatgctctgtgctctgtcaaatagtttgttcaacagaacaccacggcctagctgtaagtgccacgttaacttctagcaatgccaaagcctgtgatagtggcagcttcgggctgtttctcattcccgggatgcctaaccacctctccaaattctatcagtttgcttccacccacttcaagcttcagaacgaaacatagagcttaagaaatataggcccggcaaggtggctcacgcctgtaatcccggcactttggaaagctgagcctggtggatcacctggggtcaggggttcgagaccagcctggccaatattgtgaaaccccgtctctactaaaaaaaaaaaaaaattagctgggcatggttgcgggcgactgtaatccaagctactcgggagggtgagacaggagaatagcttgaactcgggaggcagaagttgcagtgagttgagatcgcgctattacacttaggcctgggagacaagagtgaaactgtgtctctaaataagtgtttgcaattataaaccatctccctgaccttaaatctctagactcatatacaactgcatatttgatgtatctaattgaataatgggcatctcgaacttgtccaaaatatgtttatacgtaaacaccaagtctgttcttcctctgatatttgtcatgtcaatcaatagaactccattcttcaagcagcttgggccaggaattgtgcaatattgtttgtcctgagcttcttacaactttcacccaatgcagtcagctctgttgaaaatcaatcagaatacctttcattgttttctttgctgcttctctaggagcaagctgccatggcggtttgtctgaatgaccacagtgaccccaaactggtctttgttttcacttttaatccccctgtcatacagtttttctctatccagcatcaacagtgatcctttttgaaggtattatgtccactgtctgctgaaaagattccactggctttccatcaccttcataataaaaaccagcatccttatcatagcctacaagtaagatgaccaaccattacagtttgcctgactctcaggggtttctcagggtgtaagacttacagtgctgaaacttagaaagttccaagcaaactaggatgagctgctcaacctactagatctgtactctggctaccctctgacctcattctcttcgcagttctttctcttcactgaccttgctgtttctggaatggaccaagcatttccagcatcagcacctttatatctattctttctccctagaagggtcttgtcctggatatctgaatggctctagatctcatttcattcaagcctctcctcaaataccaaccttaagaaagagacctcccataatcatcccttgtaaaataagcttttctgctcatttagcatatatatatatagttgactatcctcaatagcatatatatataacatttccccacctagaattatatatgtaataatatatttaacaaaaaatacatataactagatatattttattttgtgtttgttctctctcccccaactggaatatattttttgaaggtagggactttgttttgtcccagaagtatccctagcaccttgaacagggctgacgtttaacaggtagtttatggaggtttgttgaatgaaaggatgtgtgaattttctatgtaagtctccaggctctccactaagcccaccagaatgctaacacaatcaattccccatctcattccttgacctgccactgcctgaagcaatcagcgtgcagtttctctttagaaaatctgggggatagtctaggggttgcaaattaagcaacattatctttgttctgaacaaggactgcatgagtgttaggactgaagaaggcccaaggtggtggtgggtatgcctaagatgagtatgacatatcagcaatgctatgaacatagcaatgctatgaaaggccaggcaaaacgtaacaggagctagtcgtggcttattgttacaacgactatacctcccatatgggtaatcgatatccacacacccctctacattgactctggaattcaggaaagggaattaaaattttctaacttatgtaccccaatgatttcaacaatatctggcatatgagatcaataaatatctttaaaataccaactaagaaagacataaaatgacccaccctccataccaggctcatttttgctcctctgattcctgaaactatccagaatgcagctatgaattctctccattgtcagttttaaattaagccaagctgggtacttgtgtaattcctcaagaaatcctggatgaaaactgtcaggtggaaaacaggacctcaaaataaagagacatccatcactgaagctaacatcgtgaggctgaaatcagtcctataacaatggtaccaaaaagagcacaatgagaggcatttgtgaatatttactcagatgagagtaagatatttccctatcagctaacctgaagttcacatcccttttccagctgagttctgaagctagatgtacttaactggaacacataactgcatcaggaacatcctttaaaactatggctacaatggcttgactggacaaaccccaggcttccaggtttagcacaggtggcccttcacagaccaacattgcctatgctaccaacctcatgtcctaccaccctgcttgcatcatttctctctctgcatatataaaaatatatgtgtatgtatataatcagctttattgatatttaatataccacaaaatttgcccactttaggtacagttcaatgaattttaccgtgttttcttagttgtacaaccatcatcacaatttaatttcggaatatttctatcacccaaatttccatttctgcgtaaagggggaaaaaaaaaggttaactgctgaaggccgcggtaacactgaaaaaggtgccttttctctctaaaacagattttaatctcccctgaatttagtgtcctgggtattccaggagtctgaatagggtttcaattttcagggtctttttaatagagtaaaactgtattggtggcgataaatttagtattgctctcagtacatgattgagggatacttaaatgtctctgtgattttatttcataatcgctaaaagatggtttttttttttcctaaaacagggtttttgttttttctcaataagcttcttagcttcccctccggctccctggcttgcctcaggaaatattagctcatcagttctgattggttgacagctacgaatggccctcattgattgggcagcgcttctttgtcccttggaaactaatacaaatttttaacactactttttttccactctttcttcagagttggaatatcgttgctcccctacccatatgtagtgagtggagggcaaacttggagttcccctaatctttcctttttaggatgtcagctcagtatcattcatcttaattacacattgagcttcttgacttaatggatacagctcttcttttgtttagttgggcggccctgaaaagggcctttggttcagaaatgcaagctgtggagaaatcagcaaccttaaccgccaaagccataaagggtgcgtccctggcgcttaagcgcgtagaccacgtccatggcagtgactgtcttgcgcttggcgtgctccgtataggtgacagcgtcacggatcacgttctccaaaaacaccttgagcaccccgcgagtctcctcgtagatcagaccagagatccgcttcacaccgccacgccgggccagacgccggatggccggcttggtgatgccctggatgttgtcacgcaacaccttgcggtggcgcttggcaccccccttacccaaacccttcccgcccttaccacgtccagacatgacttcccaagaagtgaaccaagagcaagtgagagaataggaaaccgatctttatatatctacgttacccctgcccccacctccagcggacacagagactgaaaagcgcgcaggcgggaaatgtgacgcctacagtccgctcctttaacccctcctccaagccccaggaaatggcgggagcagcgattgggggagggtggggagatgagggtgggaccaagcaggcttgaccaatggcctttattttcttaacagagctacaggctttgaggaactgggttaagaattaaatgtaaacccattctgactccagaattattttaagtcgaactttttttttaaccgaatctctctgtcgcccagactggagtacattagagccatctcgattcactgaaacctctgcctctcaggttcaagtgtttctcctgcctcagccttcagagtgtacctgggattacaagcgctcgccgtcgcgcccggcgtgtttttgtatttttcgtagagacgggattcggccatgttggccaggctgatcccgaactcctgatttctggtaatccgcccgcctcagcctcttaaagtgcttgaattacaggcgtgagtcaccgcgaccggccgaaatcgattggttttgaagccttcagtagcattaaaacgaaaagtgctcccaatgcattcccttttgtcttaaattggtttcttacagctactttacttgaaaaggtggtggctctgaaaagagcctttgcttggaccgtcagagagaccacagtaatcacgccctctctccgcggatgcggcgggcgagctggatgtccttgggcatgatagtgacgcgcttggcgtggatggcgcacaggttagtgtcctcaaatagccctaccaagtaggcctcgcacgcctcctgcagagccatcacagcggagctctggaaacgcaggtctgttttaaagtcctgcgcaatctcgcgcaccaggcgctggaaaggtagtttacgaataagcagttcagtggacttctgataacggcggatctcgcgcagagccacggtgcccggccggtagcggtggggctttttcacgccgccggtggccggagcgcttttgcgggctgccttagtggccaactgtttgcgtggcgccttgccaccagtagacttccgagcagtttgcttagtgcgagccatgacggaaaaacagcacagcggaacacccaacactagcgcaaatacgcccatgagctgctctatttatagtgtgtaaagtgcagtgattggatgatagaagacgctaaatatgacgttacacactctgattggtctatctttaagccagcaacaatcgtgcagtttcaccggctactatattctattccaactctacagatgattatttaagtggtattttattactactattattttattttacttttgctttgttccccaagctggtcttaaacttgggctcaaaagatcttcccgcctcagcatccagagtagctgggattacaggggagccccactgcgccggcttggactttaattttttaaacttgtcctcttctacatctggttttcataacctgaaggctgtgtttattttccataaaacaaggcattgattccaaaggtattataattccccaattccgtataaccttcagctctttaggaaaaaaaaaaaaaaaaaaaaaagagggaatactgctcacctcctctccggaaatgtaccctttacgggaatttctgaaacctttcacaagaattggattcctttgtaatgctttaattgacttaggagtgttattgaaatctacaaagcatctcaaacatagtaggattacactattactcagaaacattttctatgagacgtctttctcttgattatgctctttgaatcctaaacttgcagcgttctgcagcttttgttttctaaagcctaggtgtactctgccagtcacaaaatggcgtttctccagcactgccgccaggtaccaccagctgggagttgttcctcttgcggagcaggaggtggacttggcccaagagaaactggatagtggttcgcaaggaacataatttagcattgccaagagctaatgcaatcattttgaaaatctcaaaacactgaaaagtggattgtgacctttttaaattcacaagagacaggccacattctatcttttgattggtttaggctattttcttgaacagccatttagaaagcagatctatcatccttcatttgcatggagcgttcccattttatttgaaaccagtttaacccaatagaaaaaagggaggcagaacccattatttaaagtggaaactcctgaatcagataattaggagtatttccttttcaaaagttgcgttttttcagatacctcgcttattacactaagaaaggtttatatctttcacaaagggtttacttacaaaaatcttccaattttgtatacctgtgtttcataactgactagccgtcaaaccaagatgtagagtttccaaccgttattttccaaatttttagaaattacgtgaaatatttgaatgcatgccttctcaataaaatgggacgtaggaagcactggtgcagaagatgggtacaatacttatctgggaccactccattatttggttggcacgttgtttgaagaaaaaggggaaaagctcaggttacttagcatggttcggacttatttgaaaactaccacagcaggagcggaaataagaccgcattacctcactctctgctgtgctgtgctagggggttatccagaataggattgtagaagtggatgtcgatttaatagttttttattctcccattagctgagtctctgattggcaatgtgagatcgttttagcttattgatactttgaaatgcacttaacagccacaaacaagttaaagggttgttaccataaaatcttatccccagggtgtgcttgcatttatcacccgtgtttgctttcacactaagtggacttaactccccagcagaatgcctgtcagggaaccggtttcgtggacccagcatttaacgcctttcgcaggcttgtgaggcccataaatatttgttgaataaaagaatgagttgaccatgtcatggtgcgctgattgcgtgtgctgacatggaacacaggttgtaaaccttaataccaatttggggcatgttgtatggatgaaaagggcattggaaattcctgaagtgcatcccacattggactgtggaaataagttgcaagtgcagaaacgtttccacacttgcagtttgagtattaattgcagcgtttgtgaattctggtgttgtctacgattcattcttgtttgacgtgaaaggtattcgcgagacacatcgctctaaaacattgccagaaaatgtaatagagttgatgacaactggccctaacacggcctaaaactcgcacttttctctccctccgcaactattcaaaacactgtattttacatttcttgcaaattaaaaactaacatctctggcaacggacctctaaaaatttctaataaaactcctcggatgcttgtggcactgcatttgtaaaccgccccctctcaacctactccctaaaaaagagctgctttttgagagagaagcggtaccctctgatgttactgggcggcagtctgcctacaatttccttcacaatgaggcaaccagagcggctttttctgtgtgtttgcttgcgttgaggggagcaggaccataggccctagaggcccccagctgccttctgagactgggcgaaaccctcggcagcgcgcagggggcgctagggcgcgaggggcgggcactgacgggcaccaatcacggcgcagtcccaccctataaataggctgcgttggggcctttttttcgcatcctgcttcgtcaggtttataccactttatttggtgtgctgtgttagtcaccatgtctgaaacagtgcctcccgcccccgccgcttctgctgctcctgagaaacctttagctggcaagaaggcaaagaaacctgctaaggctgcagcagcctccaagaaaaaacccgctggcccttccgtgtcagagctgatcgtgcaggctgcttcctcctctaaggagcgtggtggtgtgtcgttggcagctcttaaaaaggcgctggcggccgcaggctacgacgtggagaagaacaacagccgcattaagctgggcattaagagcctggtaagcaagggaacgttggtgcagacaaagggtaccggagcctcgggttccttcaagctcaacaagaaggcgtcctccgtggaaaccaagcccggcgcctcaaaggtggctacaaaaactaaggcaacgggtgcatctaaaaagctcaaaaaggccacgggggctagcaaaaagagcgtcaagactccgaaaaaggctaaaaagcctgcggcaacaaggaaatcctccaagaatccaaaaaaacccaaaactgtaaagcccaagaaagtagctaaaagccctgctaaagctaaggctgtaaaacccaaggcggccaaggctagggtgacgaagccaaagactgccaaacccaagaaagcggcacccaagaaaaagtaaattcagttagaagtttcttctagtaacccaacggctcttttaagagccacctacgcatttcaggaaaagagctgtagtacacagatgaaatcccccaagcaaatgcaacacgccctcaattatattagaatcacttggagagtcgatagaactttaacatagcctcatctagtaagaatttactactcaatctatcaaagatagcaaggtgaattcaaatgcaccgagttaaaatcgagttttaaagtcacctgggtttcggtagccggaagtcccgcgtctcacgactccaagctaattagtcataaccgtattgaaccaaggttgaagcccagtcccaggcttgaggctttttattatacaaggttaaagtggggatattgcgttttggggtcaatattgctaaagtagcattttccgaaattgggtggtcctaagaaatgcttctgggatagttggcaaaatatatggcttaaccacgccctctccacaggagtggctagcgagctgtctgtccttgggaaggacggtgaccctgctggcgtggctggcgcccacgttggcgtcctctgaaagccccgccaggtaggcctagctcgcttgctttctgcagcgccatcatgacaaagctttgaaacgcaaaatgctttctttgtgcagcgccttaccatgggtgcacttacgggctgtcgacttggtttaggcccttgtcaggacaaaggagcttagtttgttggagttttagagctgcaacccaaaatcccttgctcggtttctctgtttttagaaacggaagcgccctgattggatatttgaaaattactgtgcttaactggatcgtgtttcatcaatcgtgcaggattttcaaccctggtggagcccacacattcaaaactgaagatccttttctcagaactgcccctttaagcttttgcaattttaattctgggggtcagattttaataattggacttttttgtttacatctgacaagagtatatgatgagccaagtttactcacttttacttagtgcagttcaattctaaaagtttatttttgcgtgtgtgcatatgagttaataatcagttgtatttttcaaacggtcttttttcaattgttttgcttagctccttccatcgtctaaagtcagggatacaggcacatcacatccctgttcccccttcctcaaactaatatgtagctacctaggtttatcctttaaaacaaaaattctcacctatttttgtgagaaatatacatgtttttctttgaactaagtattttacatacacctatctatatacatgcatacttgtggttttgtttttttaaaaaaaaaaaaaaaaaaacacgttatcttttgagactgggtctcagtctgttgcccagactggactgcagtggcataatcacagcacactgtaacctccaactcctgggctcaggctatcctgcagcctcagcatccggagtagctgggattgcatgcacgcaccaccaagccgggctttttgtttttattttttgtggagacagtcacaccatgttgtccaagctggtctagaaatggcctcaagtgatcatcgacctcccaaagtgttgggattacggtcactgtgcctggccttgtatgcataattgttttgtcttttgattagggttattaatttaaaaaacaaagcctggacgcagtggctcacatctgtaatcccagcactttaggaagccggatgggcagattacttgagctcaggagttcaagaccagcctgggcaacatggtgaaatcccatcttgacaaaaaatacaaaaaattagcaaggcccagtggcacgcacttatagtcccagctacttgggaggctggggtgggaagatgactggaacctgggaggtagaggctgcagtgagcagagatcgtgccactgcactcaagcctaggtgacagaatgagacccagtctcaaaacaaaaataataaaaattttttacaacgatgttatatacacttctgcatgttgcttttctcttaaccaaacttttctaaaaccctgtcatgaaaaaagaaatccttcacatggaatagcataagttattcatccatttcttattgataagcattgatgtttccagttaccactgctgaacatggtgcaattgaatagaattccagggctgagattgctaggttttaggttgtattttattattttatttatttatttatttatttagacagagtcttactctgtcacccatggtggagtacagtgccatgacctcagttgcaacctttgcctcctgagttcaagcgattctcatgcctccggtctcccgagtagctgggattacaggcacctgccaccaggcctggctaatttttgtatttttaggagagatggggtttcaccatgttggccagactggtctcaaactcctggcctcaagtgatctggccacctcggcctcccgaagtgctgggattacaggtgtgagccatggctccagacctggactttgtcttctgtttcatcagtccttctgttggttcaagcacagtatcacactgaagactgatgattctatataaatatggtaaagactgtacaccctaactgttcttattttttaattttaaggcaattttagattccagctttccaaagaattgtggaatgcttagagctagagaagccttggaagtcatttagtttttgttttgtcagagaaaattctgtagagactctgtcctgctctcactgaataccatcccatagtaccccccaacagctttaaagggcaataataccttatggacagtatgcttttcctcaaatatattctaagccatggtcaatgcaaaagagtgagaaggaaagtagaataagttatctaagaatcagtgggtgctctctttaaactgatttatcactcccccttccaaactctcttgaaggtcactctgcctccctttctacataagaactcctaactccaagggaggaaggtaagttattcttattccttgcttagaaaaagagaaaataggtttggtaagcatccgctttctgctaccattctctgtgtttctgtgttttttataggatcattcaattattggttggctcttgagagggaatgcaaggttcaaggacacaagcctagatcttgcctgtatagaacctcatgatgttatgcttctctaaaatgaggcctggaggagacatgttgaaagtgacccataaatctgcagtatctcatgtctctcaatggggacaaggagtaccatgggaaatagcattaggtcaatgacagtaacaactcccaggtgagttgatttattcttttatttataaagttgttaatatgctacatagtccctaattttgccacaaatagtcattattttaatttcatatttcactattgataaatgaaggaaaaaatgagtagcagttaagcagtccataaacctacatataaagcaaattggagattttaaaattgattctggatgcttaaaatccttctcattgaaaaaaaatttcgtattagaagatttcaacattctttaaactgagaagcataacatataaacagaaaaccacagcaaaacaaaaatgcaaagctcaataaatgaacacaaagtgaacaccataataattgccacacaagtaaaaaaacagaaaatcagccaaccctcccagagctgcctgatgcttgcttccagtcacattatcactccatctgccctaaacataacccctattttgatttccaatgctgtaatttagtatgcctgtttttgaaacatataaaatggaaataaaacaaatgtaatcctatgtacctgacatatttcactccagaacattaggtttgaatagattcatctgtgttgctgtgtataactttaattcatttttattgttatgtaatattccatgttatgagtgcaacaatttaggtgtctactgttgatgcatatttgcttccctttttcagctaatataaacaataccgtgaatattcctgtgtatgtgtcttggtatatataggaatacatattttgtttgtatacctaggagaggaattgttgggtcaaatgctaaactctttttgaaagtggtgatattaggtttacatgcgatgaaatgaaaattaaaaccacagttataaacagcatggatgaacctcacaaacctaatgttgatggaatctagctgggaattcctgttcttccatatacttcccaatatttttttccaattaaaattgttaatcttttgaagatgttatccattgtggcagatgtgcagtattatctcattatggttttattttacatcttttgcccattttttcttaattggattgtatatcagtcgacttgggctgccataacaaaaatactagactaggtagcttgaacaaaaggaatttattacctcacagttctaaaggccaggccagaaatcctaaattgaggtgccaagagattcagtttctagtgagggctctcttattgacctgaagatagttgctgtcttagattgtttggtgctgaacagaataccagagaccaaataatttataaagaatacagatttatttcttacaattctggtggctataaagcctatggtcgaggggcccacctctggcaagggccttcttactgttatggcagatgtgagatgtcatctcatattcaaaccacagcagtcgccttttgtgtcctcatgtggcctcttcatatgcccataaaatgacctcatgtctcttccttttcttataaggacaccagatctatcagactactggcctactcttatgacctcatttaaccttaaatatctccataaagtcccaaaatccctatctccaaatataggcacattgggtgttagagtttcaacatcaattttgggggaacacaatttaggccaaaaagattgtgttttttcttgttggtttaagatagctgtctttttgtcctttttgtcctttctttttttttgaggtggactcttgctgtgtcacccgggttggagtgcagtggcgctgtctcagctcactgcaacctccacctcctgggttcaagaaattctcctcctcccaagtagctgggactacaggtgcataccaccgcgccctgctaatttttgtatttttgatagagacggggtttcaccatgttggccaggctggtctcaaactcctgacctcaggtgatccacctgcctcggcctcccaaaatgctgagattacaggtgtgagccaccaaacctggcctgtcttttctgttttaagtttttaaattttgctcacgaaccctttatccattttatgtgttgcaggtatttcctctgtaacttgtcttcactctgtcagaggctggagtgcagtggcacaatcacagctcactgcagcctccacctcccaggatcaagcgatcctcccatcttatcctccttagtaggtgggactacatgtgcaggccaccatgcccagctaatctttgtatttttttgtagagatggtgctgttgcccaagttggtctcaaactcctgagctcaagcaatccatcaaccttggcctcccaaagtgttgggactagaggtgtgagccaccactgcacccagccaatgatatctcatgatgcattaaagtcattaatttagtgtactcaaattaagcacactgcccttttatgcacaaccttttttgtatcttatttaaaaaatcattttctatttcaaggtcatgaagatcttattttataataccttcttgtgaaattagttctcaagactaccctcacttctaacaccaattataagttgggaggtctgtggttcccaatcaaccttaggttagtaatttgctaaaaggactcacagaacttgctgaagctgttagcctcatggttacaatttattataggatatatagcttattatgtcattccaatgcaatgtaaaattatacaactacttttaaaaagattttagcatttgacccaacaatttcactctgaggtatacaaacagcagatatgtgtgcacatatataccaagacacatacacagcaaaattcattgtttgtaatagttgaaaaggggaaacaactcaaggaataaagattaaaatcagctgagaaaagaaacacacaaggcagtattatggatcgaattgtatgcagatctcccttgcccccagaagatatgtttaaagtcccaactcccagtacctcagaattgtggccttatttggaaataggatagttgcagatataattagttaagatgaggttatagtacagtatgatgggctggtgacttagaagaagtagtatatatatattttttaatagaactagtattcttctaaggtggtcacgtgaagacagacacacacaggcagagactgcggttatgcagctgcaggtcaaggaatgtcaaaggttgccagcaagtacgagaagctaggaagagtcaaggaaggattttcctacaggcttcagtggaagcatagatctaatgataccttcatgtcagatttctagcttccagaactacaagagaatatatttgttgttttaagccaccctagcttctagctctttgttacagcagccctaggaaactaatataggcacaatccaggcaagttccaaatatgagcttccagttgtcctctcccagtaatatgaacagtattactttcccagcattaatgtgtgacaatacacatgacgtacagagcagtccccacttatgcacaaaacatatgttccaggacctccagtggatgtctgaaaccatggatagtactgaactctatatagctgttttttcctatacagacacagctatgataaggcttaatttataaattaggcacagtaagagattaataacaataaattagaataattgttaagaatatactgtataaaagttaggtgaatgtttatttctgaaatttaccgtttattatttttggactgcagtagaccacaggaactaaaaccatgtagaaaccgtatacaagagaactgtatttcacccgagcctcagtgtgcagttttaatggcctgccatggttgactgctcacatggccgatcttttagtctacctccacaggtagagctgatactgtgtggctcaaagttcctattataaatcacattgttgactgtgtggtggtcaaaacctccaggtaaacaaagacacacttatcagtgagaacatttcaagggtctaaaattcatctcccagtagctgagggcaaaggctagacctctttttgggtaagataaattttttaccatatactttattttgcttttcatgtttaactttattttgcttttcatgttagttcccctggaattgttttttgtgtatagtgtgaagtagggggtcaagtttctttttttttcctttttgttctttttctgtttaaaaggctatacaattgtcccatgccatttatttacaagagtcctttcaccattgttgtatggtgccactttagatgtaaatcaatgtccatatttgtttgagcctgttccattcgtttgtctatttttggacaacactgccctgattattgtcattttatcagttttgatatttaataaagcaacagatttgtttattttgggcccttggatttgtgtattaaatttgaaccctgtttgtcaatttctataataaagcttattgggaatctgattaggattacaatggttttgtagatcagtttggggacaattaatacctttaaaatattgaccgcttcaactgtaaatatactcctccattatttagttttcctgtttaatttatctgagtaatacattatagttttcttcgtagaagtcagatacgtagaaaattcaaagcccaagtgcaatagctcatgtctgtaataccagcactttgggaggccgatgtgggtggatcacctgaggtcaggagtttgagaccagactggccaacatggtgaaacctcatctctagtaaaaatacaaaaattagctgggtgtggtggcgggcacctgtaatcccagctaatcaggagactgaggcaggagaatcgcttgaacccaggaggcagaggttgcagtgagccaagttcctgtcactgcaccccaccctgggcgacagagcgagacttcgtctcaaaaaaacaaaaaaaagaacattcaaataatcaatgtagataattcaaataactaaaaaatgaacagttattaaaatatcaggatataaaagcaaaaaaatcaataacctccatatatacaaaatggccagttagagaaaaaaaaaagaataggcgagacttaaaaaggctgggaatctccctgaaaatctttgagagccttggccctgccctcagggatttctctggcttcatgcccagatatgggtacagttccttgtttaaaaaaattttgctccatcaatcaacaaggggctccttcctcagagcacaaggacctccataacaccggacactagatgtctaagggacacctcttaaggaagttagacttccaaagaatggtgtttcctctgtccccaaactctggaactcacagcacaactgctccttggagttcggtttcaaatctacaaggctgtcatggaggttgcagaccaagtccgtggcctcagtgtccggatgtacggtggccttggcacctgaatgtgagaacatgacctccctgaaaccaccacaagtattgtttcatgttatgtatgttttttcttatctgaaattccttttctttaaaaattcaaattacatatttttcaagcccctgaacaagcttcatgagcatttattgaacccacagcttttaaaacctactgaacactttgctctatgttgtcattcactatccaccaattatttaattattgatcaatattgtttccttagtgttgggatcatttatgcatgtatttcttttatattgcatattttatatttctgcattacagttattacatattacttttgctacagtaatagttcagaagtgtacatccaaaatttagctgtgaagtggatggactgaggcagaactggaggcaagaaaatgtcacagtaattctaaaaaagatgatgtacaattagagcaagagagtagcactgaaattgaagaaaaatagatgcgtttgagagaaaattaggaggtagaatcaacagattagatgtagggatgagaagggtcaaagatgacactagggtttttaactggagcaagtaggtagacagaacatttcttcctgaaagggcaggtcagatcatgtgttgtctcaaagggcatgaagagtagaaagcctgggacagatcctgagatgaccaatacccatggtgcagggagagggagggagatctgctaaaaagactgcaaatgtcaggatagtagaaaatcatgagtgtgtgatgtcctggaagttgagacagtatcacatttgagaacatttaaattggtaactctgacaaaacctggaggccaactgtgaatgcccatgagagtgagaagctcccacacttttgtgggcatcagaaagcccaccaggttcctgcagtgaagatctgagaaggatcctcttgtggctttggcagggagagaagaattattatgaaatacaccccagaaccttcttcaaaacaaaggcctactctcaaggggaaaacattttgccagagtcttatcccagctgggagaaggtaattcttcccactgcagcctcatctaggctttctgtctcacttaagggaagaaaattagtcaacagggatcagagcttcatgaaaataaattggaaatggtgcagccaggaaaggagcaaaggtctgaggaggaggagaaggaggaagaggagttgtatcattataaatacttgaggaagaggaggagaaggaggaggaggaggagttgtatcattataaacacttgaggaagaggaggaggagaaggaggaggaggagttgtatcattataaacacttgaggaagaggaggaggagaaggaggaggaggaggagttgtatcattataaacacttgtgacggtcccagccccaagatataggcatgctaataaactgaggcttaacactttgactacagaatgctgcttctccctaacaccatcaaggctccaactgaataacaatgaattatgaatgaaagagctgtaaggagagacaaaagttagaatgagacaagtattgttatctagagatgccaagaaggcaaggaagataactaaaaaggcactctggatttagaaataggaagtcattagtgaccttgtaaataatggagccagaggaataccaagggcagaagcctcactatagtgtgttgcacctgtcagaggtcaggaggtgtaactgactctcccacagtgtggctttggaagagagaagtcagcagctgcatggagatttgggagagggaaagctttttttttttttttttaattggaaaagactgagctatgtgtaaatagaataagacaggaagagtgtagacacaggaaagagggcagacaaaaacaagtgcacagttatctaagggaaacaatgggatcaagctgcaagtatataaacttgtcttgatagaagaatccttgatctggtttattcagtgtttggtccaaacccacatccctgttctgcctgtctctgacttgctctgtgccccagaagcccagcttctacagatagcattagctgggcagccctgccctcttgcaacagctggatttggccagtgatcagcccagcaggaatgtagatggcaaaggagagagaggttagtgtacttattccctgcatcacccccctgcttggtgggcagctcttcctccacagtcccagctctggcctagctctggttacaggttccctcccattgcctcttcagatttaaaggtgtgtctgtcagggtataactgggagctagaaattgcactgaaattgaacaaagaattttatgggaatggttgttaactagttataagaggactgaaaatggaaaagtggaacaaacgtatcagagatagtaatgacagaaagcaactaccacctccaggtttaggagaacaaggaaaagattctttgaagagatccccagaactgggacctctgaggagtgtatgctggaccactgatgatgatatgtctgtagatagaggcatgatgaggctgattttaggagcatggaagatctccaaactgaagccaactgctgttactggattcaactgccactgccaggttgaagaacccattctgtgaggatgtcaacaaacaaagtgggaaatcttttcacatccttccagccctctagtcttcctccagtgctttctattggtagggtttggggaggtggctagcaaagcggtattggaaaagatagaagagactaaatcttcataaccagcacagggtgacactggatcactactgttgctgatcttgggctgcctcatatcccctgttcttcccattagccctgtcacaactttgtagatatcccttcattatatgcccttcatatattcttttggtttaactttttctgttggaatcctaatatggcactcctccatttttcaggaccaaaagagtataaaagattatcttttaccaaaaaaaagacaaaaaactgatctaattcctgatttgatcattacacaatctatacatgtatcaaaatatcacatagtaccccataaatatatacaactgtgtccattaaaaataaaaattaaagaaaagatggtaaatatagctctgtcaggcagtggaggttttaccacgatggctgttatttcccccatgaaggggggagtgagggagcagctgaaagtaggtgcttataggggtatagaggggctcaaagctttgagagaggagaatgtctgaaagagctgccaaatagcatgcaggtcccatgggggcagagcctctgctcattcaccagtgcctcttcaatatctacacttaagcctaacacaaagtgtgtgcttaataagtatttgctgagtatgtaaagtggaaacagaaccaatctggcaaactttgtaggactggtgggcaatgaagatcagtcaggtaaaatctgtggatataaatttatattgatcaaaaaattcaaggttaggtgtttttcttcagtcatgctcaacgatgcttcagccatgctcaactcttctgtagccacagaaaaaagtttacccataatcgagctgtgtctgtgtctgaataatgaaaagaccatgatgcaagggagttggagacacagaaacagtgtttgaagtaatgggtaatggaagcatgctaccagggaaaggaaagaagtggcaataggaaggaacagagatctgtggtcctatgtcccctgagcatattcacatgttaaagctaattcagttttcaatcatcattaaaattttgttcctaaatatatggccattattttccacaaccacactaaaactttattacctctggcaagtgactatgcaagtaactaagagcaaaaatatccacaactaccatttgagctatcaatttagggaaagtcatctggctataatctaagtgaccctccactgaatgtcagtatctttgcatatgtgatttaaatctgggccttcgcaacaccatgaactgttcttgtcttgaatatccagattgaaggaaataatctgagtagttacgagtcctgaagctagaaagatggaaaccccatttgctcatcagaaagccttagagcttgggcgctggcgggtcctgtctcaccgggacagaggggctctttcctccccatctgatagtctgataactagagaagccggccaacttattctccaagaaggagccatcttagttcctcctgaaatgttcatatttagaaattattgtttgtcagtaatttaaccccttaatgggcttgccttgtggtccataccactgagtgcagagcttgcctggaagaattgtgagggccattccatcttccaggcagtagagttcagtacttctttaaaattgctgctgaactctgtatttgaaaagaaagaatcatttgggtgtggtagctcacacctgtaatcctagcgctttgggaggctgaggtgggaggatcatttgatgccaggaggaccacttgagaccaccctgggtaacatagcaagaccctgtctttagaaaaaaaaaatacaataaaataaatacaataaaaataaaagcaaaaagaaagagtccatcttagggacagactgtaactactcactggagcttacctttacatagttcaggatcaattataataaaacacttttgtgcagattcaataggattattttaatccccatcatctctctgagtttccagtcagtttctctgcatgtagacacccttctccagcccaccattgtctctcctcctatagctccaccaacaaatcagaactttttctaactgcacctagtgcacctagagtctactccagaatgctcatggagaaagtttctgaaaggtaaaactctgaatgatatttgtagctaaagggagacttgctagagacaataagctaatagttgtagacttcagtagaagaggaatgacactgcaatgtcagggtgcaggacttcaagagggcagagtatggaaacccaatgggaaaaatgctcaccaggaacatgaagagaaggaattacgtgtaaggatttctcaatgtgttcccaaatttgcccagcagagggaggcctcgggttgatggcaggctgaccacacaattaaagaaggctgaacctgggggcttttaacaaccatcgtgggctctactgtaagcatttagaaaaagaaagttatccattcaaaaatatatatatttttaaacttcagaacaaaattatgaagagctatatttacttttctacattctaatttttataaatctgagtatattttgcatatattgttatagtacatattcaattttgtattttgctgttttcacttaaccatttttactagattactctgtgttcataataatcacttttttaaaacttttatttttatttatttattttttttttgagtcagagtcacactctgtcgcccaggctggagtgcagtggcgtgatcttggcttactgcaacttccacctcctggattcaagcagttctcctgccttagcctcctgagcagctgggattacaggtgtgcaccaccaagcccggctaatttttgtatttttagtaaagacggggtttcaccatgttggtcaggctggtctccaactcctgacctcatgatctgcccaccttggcctcccaaagtgctgggataatcactttttatgctgcataattcttcagatttgtcagtacgactgtatttacactcatttgttttattagaaagaattccagaatattttggctgccctaattaattttacaattaatatgattttgaaattgggtattggctccttctgaattggtttattaaaatatattctaatgtaatttatgacattttcatcatattagcatatttattctgttagaatttcataatttataaagctacaaactgtatgtgatatagcttgtaactttatctcataactttatgcagttacaagtagaaataaaatgttcccctcaagattgcttaaaattttattataaacaagtgtaaaaaacaaaatcactaaaacactccctcttttttcccccaaaatgcatgtttccattttaacagaacccgtatttaatcagcagatttctatggtggctagatttgtagactaaatattaaaagtcccaaagcaaatgcatttttctcttaaattttactgactttttttttttttctttttctgagacggagtcttgctctgtcgcccaggctggaatgcagtggcacaatctcggctcactgcaacctccgcctcccggattcacgccattctcctgcctcaacctcccgagtagctgggaccacaggcgcccgccaccacgcccagctaattttttgtatttttagtagagacagggtttcaccgtgttagccgggatggtctcgatctcctgacctcatgatctgcccacctcagcctcccaaagtgctaggatcacaggcatgagccaccgcgccccgcctactgacttttatccaaagaaaatataagagctcttcatcataacgtatgtttcttgctcttgttattaaatatgacacatttagacttaaactgatttgaaggtttatgacattgtttaagttattacataattaattcataaagataatgactagtttgaactactgacagctcacacatcatcagttgaacagcagaaagcttattaagctactttcttatgtttctgtctcccagctactaaaagaaacgaaacccttccaggtgttaaggcaaaactttcctccccctttcttctataaatctgattccatgttagtgaaatttctactgatggctttggtttcctctatagtagaatagagatcctatggcaaaagtcatgtctgacatggtagcaaatagaaatggggaaaaggaaggtctgcaagagccaatgtgggaaatggggagaggactgactacaaaaacccagcaggaattccagaagaaaactcctcaggacgggcacattggctcatgcctgtaatcccagtactttgggaggccgaggtgggcagatcacttgagtccaggagtttgagaccagcctggtcaacatggcgaaacctcatctctacaaaaaataaaaaaatttgtcaggcgtggtggcatgcacctgtagtcccagctactcaagagacttaagtgggagaatcactcgagccttggaggtggaggttggtgagccgagatcacgccactgcattccagcctgggcgacaaagtgagacgccatctcaatcaatcagtctcctcgaaaagcaacattatggagagacaggattccgtcaaggcctggggcacacaggaaaatattaaggcagaagagagtttcctccccacaccacaccgtatcccacaggcactgcggatgtgcatatgcaagaggggttgatcctaagaatttagagtcacagaggaggaggcaccaagcagactgtggagaaagtcatgaccagaaagggacagaatgtaaagcttcagctgattatctggcctcagggattccagaggaactggtcccaatggtctcctggtgatgtaggttcttaggtttcttttacaggggttttctgggagatcgttgacccagttagcattcaagcaacttccaccctgcacttttattctttccccttcacctgcttaggttttatctgtccaggcaataataataaaattattgagccctggacatgtacctgtaaagctccttaaagatgatgccttctaactcctcattcaacagatacaaaaacattacaataaaatgactcatgcaagacacccaggtagtttatagcagctaataaaaacagaataactataaaatatggtaagtttataaaagttacattgagtatactttataagaactgcttattgagtttgcctaataaccacacagcacaataataatatgtatatatttttaaatatgtgtaaatatgtgtaacacaaacttgtagaaggtatatctgagtacaaccctattctgtttggttaccttttctagttcattatgtaagtggcatagctacctaaggacttatgcttataaatgttactcaaaaaaatacagaggacatatgtggatagataatggaagagataagataggtaggttgaagggttgggctgcccctccacacctgtgggtgtttctcgttaggtggaatgagagacttggaaaagaaagagacacagagacaaagtatagagaaagaaaaaaaggggtccaggggaccggtgttcagcatacggaggatcccaccggcctctgagttcccttagtatttattgatcattattgggtgtttctcggagagggggatgtggcagggtcaaaggataatagtggagagaaggtcagcaggtaaacacgtgaacaaaggtctctgcatcataaacaaggtaaagaattaagtgctgtgctttagatatgcatacacataaacatctcaatgacttgaagagcagtattgctgccagcatgtcccacctccagccctaaggcagttttcccctatctcagtagatggaatatacaatcgggttttacactgagacattccattgcccagggacgagcaggagacagatgccttcctcttgtctcaactgcaaagaggcgttccttcctcttttactaatcctcctcagcacagaccctttacgggtgtcgggctgggggacggtcaggtctttcccttcccacgaggccacatttcagactatcacatggggagaaaccttggacaatacctggctttcctaggcagaggtccctgtggccttcctcagtgttttgtgtccctgagtacttgagattagggagtggagatgactcttaacgagcatgctgccttcaagcatttctttaacaaagcacatcttgcacagcccttaatccatttaaccctgagttgacacagcatatgtctcagggagcacagggttggggctagggttagattaacagcatctcaaggcagaagaatttttcttagtacagaacaaaatggagtctcctatgtctacttctttctacacagacacagtaacaatgtgatctctctctcttttccccacaggaggtgatggccggaagaacatggcagagggcaaaacaaaacagcattgggaacaagctctgtttaaaaggagacttgtgaacagcaaagagtagaaagggttctcttacaactgaagcccatggaagacaaatgtgtactgcgtgagttttaaggcaataggagtagtgggacctagggcacaccagagagcatattaactctcaaacttttaaaaacattatatctgctggacacagtggctcacaccttaatcctacaactttgggaggccgaggcgggcgggtgtagcttgagcccaggagttcgagaccaacctgggcaacatggcaaaatcccgtccctacaaaacaaacaaacaaaaaacaaaattagccaggcacggtgatgcgtacctgtggtcccagctactcagaggctgaggtgggaggatcgcttgagccccgggaggttaaggctgcagtgagccatgataatgccactgcatctcagcctgggcaacagagggagaacctgtctcaaaacaaaaacaaaaacacaccatacccaaccacaatgcatctgtcttaagtaccagtaccacacccctctactcactactaaataggtgagttcccaatccctggtagcaggtttaagcatgttatattaaaggtcttaggctagtgactcattcactcattaaacaaatacttattgtgcatctactataaactaagtactgtgctaggtacaaaagcaaataatctaagctctataaactttactttcttcatcaacaaaatggagatgttttaggcatctactcatcattctgagctccatcttttgtgactgtagttggcagagctttttatcagtttctctaaatagctctaccagtccctggtggatgctggcatgcccaaaggatccatcctgatggccctgtctgcttaccttacctgcctgcctttgcagcaccgctctgctcttctgcaggacttcccttatcctttggggtcttgctgctcttaggctgctctgcttgttttgatctgctttgcatcacatgtatgtaaaggtcctttccttatttacccatgaccaaggtattatgagattctggaatttccccaaaccacattgattgctgggagaatagaagaagtggattacaagtggaacttagaaggggagtattcgagaagacgtctctgcaaatccatttagagagacctttctccagtggtgactcaaagatgcagctcctttcatcctgtggcttggccatcttcagcacatggctcccaaggatgtcctcaggatggtctctaatccaaggagcctgaagagaaaaaaaggcatggagtattgtgagtggtaggtggttatggaccagttatggaagaatacacatcacttttgcccaccttctactaaccagaactcacacagccatagacactgacaagtaggacttaacaagaatctaattttgagtctaggaatacgactgtagcaaatatttaacagcttcaaacacaggtgcattgctatcactatgcttggcccaggcctgtctccctttcctgccatgtcacaggggccagcatttatgtctagattgggttggttgggatattaagacaataatgaaccaatacaacatcttgagcataaaaccaactgatacaatgatgtacaagtcagatgattctgatgattatgaattatgtcaataaaagaaatgtgataactaaggtaatttttgttttggcaaatttttgtttgttcatgacaggatgaaatcctgtcatttgtagcaacatggatggaattgcaggatactacattaagtgaaataagccagaaacagaaagttaaacaccacatgttctcacttatatgcagaagctagctaactaagtaaataagtttatctcattgaagtaaaaagtacaacagagattactagaggctgggaatggtaggggaaagagatgataaagagagattcattaaaataagttacagctagataagagcaatcagttctagtgttctatttgtactacagaatggcaatagttaacagtaataaataatttcaaagagctagaaaagaggacattgaatgtttccaacacaaagaaatgagaaatgcttgaaataatggatattctaattaattaccctgatctgatcactatacacagtatgtataaaaataacactatgggctgggcgcagtggctcacacctgtaatcccagcactttgggaggccaaggtaagcagatcacttgaggtcaggagttagagaccagtctggccaacatagtgaaactccatccctactaaaaatacaaaaatcagccaggcgtggtggcatgtgcctgtaatcccagctactcaggaggctgaggcaagagaattgcttgaacccaggaggcggaggttgcagtgagccgaaatcgcgccactgcactccagcctgggtaacagagcaaggctctgtttcaaaaataaataaatacataaataaatattttttaaaaaaagaacatcactatgcaccccatatatacatataattattatgtcaatttgaaacataattttgaaaaatgaaaaaatgaaacacaaatatgaatcaatcctctccaagttgatatacttaaaaggaaaaaagtccgagggcttaaactattcaatcaaaattttattaaaatgctatagtaatctggaaagtatttcagaatgaattggtataaggttagacacaaagatcagtgaaacaaaatagagaacccagaaatagattcacacatctatggacaactggttttgacaaaggtgtcaaggctatttaataagtaaaaaaatcgtcttttcagtaaatgtttcttgaacaagtagacatccggtgtgggggagaggagcaggagccttacctcaaactttatgcaaaaattaactcaaaatagaccatagacttaaatgtaaaagctaaaattataaaacttctttaaaaaataggagaaaatcatcaacaccctaggattagcaaagatttctttaaaacaaaacaacaggtttatagtttataaaacataaataacaaaatgataaatttcatcaaaagtgaaaatttgcttttcaaaaaacattataaaatgaaaagcaggaggctgaggcatgagaatcactggaacccgggagctacaggttgcagtgagccaagatggtgccactgcactccagcctgggtgacaaagtgagactcttcctaaaaaataaataaataaataaataaatagaaaagaaaaagaaaaatcacaggctgagagaaaatatttataatacatgtatctgacaaaggactcgcacctggaaaatataaggaaccttataacttagtaagatgacaagccaaaacaaagagtaaaagttttcaacagacatttcacaaaagaaaacatacaaatggccagtatgcacatgaaaagattttaaacatcattagttactagggaaatgcaagtcaaaaccacaatgagatacttcacattcaacagaatagctaatgttaaaaggactgacaatccccagggtgagcaagggtgtggaggaaactactctcatatattgtgaatgtaagaggacaatgttacaactactttgaaaaaagtttggctgtttctaacataaaattaaacacttatacagcccagcaatatttctgggtcatttctcccagataaatgaacacatgtccatactatgacatgtacaaatgttcatactggctttgtttcacaatgctataaactggaaacaacccacgtgtccatcaacaggtgaatgggtaaataaattgtaatatatcggccagacgcagtggttcatgcctgtaatcccaaaactttgggaggccaagatgtacggatcacctgagatcaggagtttgagaccagcccatccaacatggtgaaaccccatctctactaaaaaattagctgggcatggtcacgggcgcctgtaatcccagctactcggaaggctgaggcaagagaatcacttgaaccgaagaggcggaggttgcagtgagccaagaccatgccattgcacttcagcctgggcaacaagatggaaactccatctcaaaaaaaaaaaaaaattgcaatatatctatatcttggaatattataaagcaataaaagggaataaactactgatatatacacaaaatggatgaatctcaaaaatgtgaaggaaaataaaaaatacatatgatataaattccattcatatgaaattttaggaatgggaaaactaagctgtaattatggaaagtacatcagtggctgcctggggccaagaggatggaagaggcggcacaggtgatactacaaatggaaactatctaggttgacggaagtgttctgtaacttgattacagtagtaactgtttgggtatataaaacgcatcaaattgtataattaatacaggtgtattttactgtgtataaattattcctcaataaagttgatttttcattaaatatattatttgctaaaatgaggagagacaactattatcttaaaatagttaagcacaataaaaatactacaatcaactcattatatatggaaattaaaggagaaaaatagtggtatgattaattaaaataaaaagaaaaccttctaaattttatcttagctcatagttgtaaaagctgccatccctaaccaaggccacccttgaccctttctcatgttccatctttctgtttgtttcatagtttatgtctcaccaaaatctatcagataaacgtattcatatgaagatttaaatatattacatgttaagccttagcgaatacttcaatatctaaagaaggtacaaacaaaacaaaaatcaacacttagttataagagattacatactctccagggaagacctgaagactagcccctttctggatcccactagcccctcatcccactccaagccctcccctccaatcccatatgcactgggcattcatacaaataagaccatcagctctggatatctgtactgattgatgctcctgctaactacctgaatgattgcgatgtaaggacagcactgcctgaatcctatttatctctcgctatgccatagcggccttccatgctgatggcgtgtttgaggatccagaggggtctttggttggcaggattgttttatttccccaagaggagagccttgatgcaaaaataggtgaagaaatcagtacaacaaaacagaaagcctagaaactactatgaacacaatagagcagaagtagccttaagagttggtggagaaaggatggtctattcaattacctgagctgagaaactggctttcatatggaataaaaataaaattatagctataccccatatcatacacaaaagtttctacatctaacaaagacacagatagaaaatgttttaaaattttagaagaaaatagtgcagaattttagtgcagaatttcttagactagatgcaaaaacaaaaatgattaaagtggccaggcacggtggcttatgcctgtaatctcagcactctgggaggccgaggtaggtggattagtggaggtcatgatttcgagaccagcctggacaacatagtgaaaccccatctctactaaaatacaaaaattggtagggtgtggtggctcacgcttttaatcccagctacttgggagtctgaggcaggagaatcacttgaacctgggaggcagaggttgcagtgaggggagatggcgccactgcactccagcctgagcaacacagcgagactctgtctcaaaaaaatctaaaaataaaaagattatttttaaaagactattttaaacaaaaaaaatcgtttaaatgatatgatacactacatctaatatttggaaaagtacttcttaatacttttaataaaaagaggcgctgagagcatacaacctatcctcagaagagtgtttgacctctaggagggacgcaagcgcgttcttccttcattttaactggtcattttcatttatttcaggaacatctgaagtaaacacagtcacacgttaacctttaaaaatctaggaggtgcgtacgcatagttccattacttcaatttttgtacttttgcattttaaaatatcacagggaagctcggtacagcttcaaggctaggaggggtggctctctcttaagccctgtccccgccagccccagacctctcgtcccgcccccattgcccagtccccaccctcacttccccatttccccactcccgcggtctcttaacgcacctgtttttcgtccagtggactcagacctgtactcttccaccaggatcggctcctttcccggagctctcgctcttagaggaaattgagagaagcatcagcggagacccatctgtggctctccagagggcgcggcattcagaccccagatccagctgtgagaacggaccccaggctcacaccaggcctgcgggaggcggcccaccagaggcgctagaaaacaagcctcgcggggaggcgcgcagggcgactgcaagctgtagggggcgctggcgccctcacaggccaggggcagggccggcgctgcgggcggggctcctgcggcgtgaggggcggccccaggccagcagctgcgccctggctgggagccggggagcatttgctgctctgctggaccctgagtctggcggcgggcggcctcctctccgctccccgcccgccatcccccaactcccgatctctctgctgcgtctggcctcaggctgagaccccaacgaatcattccccgcatgggaacattttatgatataactgaattcagttttatgtataactgaattacggatatgagaatctcaaatgaggacgaatggtttttacgcacaaaacatgagacacaaatctgtaagaaatataaagtcgtgaccacgtcctttcagaactttaacctgtttgctgaagtacgtcagtaacaatggcagggaaagggtatcttaaatttcaccacagcctcaaagaggccatttcgtggatccgctgaggcttggagtcggccttctgaccacgagtcctgcggctatgaaagaggaagccgcggttcagggcgtcctcgcgagtcgcgcagcccgccctgctccagctggggacacaggtggtcacggcgctttccagctgcagatccaggcggcagcccaagatttggtccagccgccaaggggtggctcgagtgactgacgggccttgaacgctcccaggacccacatctggagagggaggtgggggtggggtgctgaagtcattcttggggcccctgggggcgggcatggacctgggtaaggccagagaaattgacacctcgtgacatccctggaagagaagtacgttcagtgtcactccagagctgaaagataccgccttctggctggtccctcctcacctacatacttttctaatttgtctggagcaggccgggcatctgtattatctggttatttaaatatctggttatttaaaagctctccattaaattcacatacacgaaaataaaaattaaaaaaaattttaaaaaaaagaaacaaaagctctctaatgaccaagtcctacacgatagtgaataaatttttttgtgtggtccctaaaattgagttcatgccttttctgaagtaatagacgcccagagaagggatcgacttacccatcatgccacagagattaattggccccagaattctttagcagaccgtgtatatgaacgtcctttgcaatcatataaattaactgggaaaacctcatttagtatgttacatgcctagcgttttgtgcctgaacaccttacaagaaccagggactattgccccaatattatatttcaggaaaggaaggcccagacaaatggtgtcactggtccactttcacccagttggtaaatgaaaccagaaattatagctgtaccacagaaaggtgaaaacgtttcttttataatttcacatacaatctttaatggacccagtgtccaacacattaaagcaagtgctcaggagtgacatcaagatgtaaaaaatagtcctgtcctcagggagtttaggtcttggagaaaagagacccaaggagacacaagacaaaggggaaagagaaggagcgctgaagactgaggaccctgcctgtggactgaagtgaggatggggacacccgatgcccggaatatgacagtttggaggggcctgaaggactcttctattctctatcagaaaaacagaattactctcctaaccagaaaaggtatttcaatttatattttccatcacagcacttttctggtgataatttaatgtgttttaaaaaatgtatcacagtgatggcctggtgtgaaataaataataaaattttaagaattaaaaaatataaaaatcttttatatagacattaggagttacaaggataactgtgaattataattagtaattaaattgaaatactgattattttcatttttatttaattatttaataaaacctatttaacatttaatatttatcagtaattaaatctaattgttaatatttattattataaattattttagaattaaaaataagtgtagaagcgaggcatggtggctcaagcctgtaatcccaacactttgggaggctaaggtgggaggattgcttgagcccagtagttcaagaccagcctgggcaacatggagaaaccctgtctcaatacaaaaaaatgagccatgtgtggtggtgcgtgcctgtattcccagccattctggaggctgaggtgggaggatgacttgagcctaggcagtcaaggctgcagtgagccctgatcttgccactgcactccagtctgggcaacagagcaagaccctgtgtcaatatacatatggacaaacttaaaatttaaaatgaaagcatactactgatacagaattgagtagagatgcaaagctagtcctataaccagaacaataaagataaaaaggagagtggaagaaggtatgtcatgaatttcatgataaatggcaattgcaaatatcctgtagcagaacaaaacaacaaaattgtagataaaacatatccaaccctttggaaggccaaggagggaggattgtttgagcccagaagttggagaccagcctgggcaacatagtgagaccctgtatctaaaaaggaagaaagaaaaaaaaaaaaaaggatgataaagtagacaatattgaaagccattttctgcaaatacatagtgaatttgatcagtaattttcttccaacagtgcaaaaatgaatagatattagttgcctgaaataaaaatcaaatatccaacaaaaaatattgactatctaatagtatctaagctagtaaatttggccagttataaaatgtcttaaatttttatttaaaaaaagaaaaccatatttataagaagaggtgataaagagaaattatttcagttatgaagattttgttagaaaactatgagaaaaaaactattttttgttttcaaaaagtgaaagattaagttaccaaacagttgctaaagaataccagatggctgagcgtggtgacttatgcctgtaatcccagtactttggaaggccaaggcaggaggatcattttaggcctggagttcgagaccagcctgggcactgtagcaagacccgtctctattaaaaaaaaaaaaaaaaaaaaaaaagaataccagaccttgctaacaatagcaaagatcaattaattcaaaatttgaaaaactgtaatttatttagctttagagtactctcgtgatatgagattgccaaattaatactttgggtgcatttcttttctcaaaggacttgcaaatttacaaagaagtgttgaagaaaagccacacattggcaggtaatgtttgcaaaagacagatctgatgaagaacaatatttttagaatatacaaagaatacttaaaactcaacagtaagaaaataacctgatttaaagcaggccaatgacctgaacatctgttcaccaaagaagatacacagatgcaagtatgcatatgaaaagatgcttgacatcatgtcattagggaactgcaaattaaaacaagtagataccactgcatacctagtagaatgaccaaaatttagaacactgtcagcaccaaaggttgcaaagatatgtagcaatagtaacttgttcattactggtgagaatgcaaaatgtgcaatcactttggaagacagtttggtggtttcttacaaaagtaaccatacttttaccataagattcaccaatcacactccttagtatttatccaaaggaattgaaaacttatctccacacaaaaacctgcacatagatgtttatagcagctttattcataatttatccaaaacttggaaacaagatgtctttcagtaggtaagtggataactgtggtacttctgaataatggaatgttatttagagttaaaaagaaatgcattcactttgggaggccgaagtgggtggattgcttgaggccaggagtttgagaccagcctggtcaacatgggaaaaccccaattagccgggcatagtggcgtgagcctgtaatcccagctactcgggaggctgagatatgagaatcgtttgaacctgggagatggaggttgcagtgagccagtgccactgcacttcagcctgggcaacagagcaagactcctctgtctcaaaaaaaaaaaaaaaaaaaaaaaaaaaaaaagaaagaaaagaaaaaagaaaaagaaaaagaaaagaaacgatcaagccatgaaaacacatgaaggaaacttaaatgtatgttactaaaaagccaacctgaaaagactgcatactatatgactccaactgatgcagggcaagcaagccaaaaattagggcttagcccgggaagaattcaagggtgaagtggtggtgttagcaacttttactgaagcagcagtgtacaacagcagaacaggtactgctccttgctgagcagggctaacccataagtaatgtgcccagagtagcagctcaggggcagttctgcagtaatatacctgcttttagttaagtgcatgttaagggggattatgcagaaatttctagaaaaagagtggtaacttcggagtaggtacagaggaaagaagtcgataatgtcctgttgttgccatggcaacgaaaaactgacatggcgctggtgggcgtgtcttatggagaggtgctttaacctcgtccctgtttcggctagtcttcaatctggtccggagtaaagtccctgcctccggagttcactcctgcttcctgcttcacaactgtatgacactctagaaaagacagtaactatggacacagtcaaaagattagttgatagaaattgggtgacaggaagtgttgaaaaggcagaacacaggatttttagggcagtgaaacttctgtgatactataatggtgaatacatgacattatacatttgtcaaaacccatagaaagcacaacaccaagaataaaccctaatgtaaattacagactttcgttgataatgacgtgtcaatgtaagttcaattgtaataaatgtactactgtggtgctggatgtctatggtggggggacatttttgcttcaatagttacagttgaagtaaatgtttgtgtttcccacaatgcatatgtagaaactctcacattcaatgtgatggtctttggaggtgggctctttgggtgatagttaggtttagttgagatcctagcagatcgagtcttcatgatgggcatgatgggactggtcccttataagaaaagaccagaaagctagctctctctttgccatgtgaagacatagcaggaaggtagccatctgcaagctaggaaagggccttcacaaagaatcaactcagacctcagaacagtgagagataaattgtcgttgtttaagtcactcaggctgtggtattttgtttcagcagcccaacctaagactgttaattggattagaaatttccttttggggatggtgtgtggcggggggtgcggggagtacctttgttaagcttttatatcaatgagtttgtaggcttttcttttttggtcattgactaggacagtttaaatagtatgagtgtgaaggagattgttggtcatctattcgatgtcccttctctgttttttaatatgagaactcctgattttcagccaactaccctggaaaaaaagctaatctttctgacttcttaagtgtggccatgtactaaattctggctaatgcaaggcaagccaaaggttttatgataggttttaggacactagagtaaaagagagctgttgcacacatgctcttcaccctacttttgtgtccttttttccatcctacaacttgggttgtgagtatgatggctggaactttagtggctctcttggatcccaggggtaattgaggggtggctggaaggaatctgtgattttctggagtttccatacacaaacaagacctggattttctgggcttcccagacttccacatctagacttgctttaaatgggagagaaataaacttgtttcagccactgtcattttgggctattttatagaacttaatctaatcttcaagggtacatgaattgcttttccttaaaaaaaaaatcagccataaaatcatcttcttttttcttttgttccccacattatttagttggagctctgtaactttttttttttttttttttgagacaaggtcttgctctgtcacttaggctggaattcagtggcatgaccatggctcactgcagccttgccctcctaggctcaagcaatcctcgtctcagcctcctgagtagctgaaactaaggcacatgccaccatgcccagctaatttcttttcttttagagatgggagccttgcccaggctagtctcaaactcctagcctcaagtgatcctcccatctcagcctcccaaagtgacaggattacaggtgtgagccaccatgcctggctgctctgtaagtgtctgaatttcattttgtatttatcagtctgtttagattttctttcccttcttgggtcagttaggccattggtttctttttaaaggttttcaaatttatttgcatctaattcttcaaattactctcaaaattattccagtatatattcttttgttcctattttcttctgtattctttattaaaatagctaatgatttatctagcaggacttatattctttccataactttcctgcaccccaattaatctccaattttatatttcttctggccttccttatagtttccacaggtttattttattcattttttaaaacttttatttaattgtttattttattatcattctttcttattcagcaatctaagtgcttagggatatagaatttcctctaagcagcatatgctaggctttaacaatgttagggaggcctcccctttctggggaagaccacacttacattaacacaggactgtgggatgccaagaggtagagaagagcttatgaatatccagattacatcttcactgatcctgcacaaaggtggggttcctcggttacccactgggtcctattacccaagtctgggtcagcataccgagactacgggtatatagaacaagtgcaactggcgataatccttctgttggggagaaaaatcttttttttctattcatcttaggttctccatctgtggccctatcaagtagactaacaaaagacagattgacaagacagaaacaaagcatgtgcattgtacaaacacaggggagtactgagatgaatactcaaaagaggatttagaacttgggcttatatagcattttaagaaaagaatacattttttaagtgacaaggaagacgaaaaggactttgagtttctagtgcagtaaattgtgggaaggcaactttttctttcccttttttttttttttttttttaaaaaaaagacttctctggtgctatgtccaggctgataagagtctaaagtctctggtgactaacttttgttcttccccgagtaagaagacaccttcacaatttcatatcctgcttttaggcaaacagggagagggcagaggtgtttgtttgtttttaatctattttttttctcaattgtcttcaactcaaaatacttcttatgccaaagatggcatattctgctacccttcacttactacttacaacccagcctctatcatcataattagaacttctgaccctggggaacatgggcaatagtttgaactcttttatatctcccttaggcagagatggaggcccagccatgcctctgacatctagacacaactgttgcttcatttctcctattctcagaggtgatgttgtaggacttcaacaaatatcagtaaacattaattttttttttccttgaggcacagcatgatcttggcttactgcagctgctgcaggctcaagcaattctcctgccttggcctcacgagtagctgggttacaggcccctaccaccatgcccggctaatttttgtatttttagtagagacagggtttcaccatgttggccaggctggtgttgaactcctgacctcaagtgatccacctgcctcagcctcacatagttctgggattacaggcgtgagccaccatgcctggccatcaatttttatgtcaactctaaattataacatttagcaattttgtgactttttatggtcatcattaatgttgtttatgttttagttgtagtcctgtcattactcactcgggtatggtaatttggtctttttcaaaatgaagttaaggtctatttgctcttctctgaatcataataagaactgccaacagccatttcagcaataactatttactgagattttaaaatatttcaaggtaattggtcctagcagactggaaaataccaaattcttttccagaactgaatcccccatcaaagttcaattttactcataattcccttttcatttgaagcatctcattgtaagccagtcttaacccttctctcacactttgcttggctgtttctcaggtagaactcagtaagtctggtagcctccaggactgccgcttagattattaaacaacatgtcagtggttggaagagtcaatgttattttgatttttctgttttgttttgttttaaatgcagttggcggataattgcagctttctttcattccctacatgagttcaaatggcagcaaacaaactaggagaacgcagaccttctgacttgtgggtacccctactcatcacctgaagacccttggaaatcaaagccctgacccattaaagacggatggagacagcaacatacgatcatcactattatcttgctttgccccagtccaggttaaccatctgtggtatttttagttgctaagtccatatattcaacataaatcaattatatatccactaaaatctcagcactagtctaactactaaggaaatgacagcgaagaaaacagaccaaacgtctgcccttatgggatttatattattttctctgtgctggttaaaccaaggagcttctgctcttttccttagtcacctgggggaggcagaaacaaaggagaatattgataaacctggaaatagggccggagagtatcagagaaggaagccttcgggaaagtaaagatgtggcagccagtattcccgttataaaaggatacaactccggcctcatagtccagaaaaattcccacaagcaggggctgctcatgcagatgaagggaagttgggggagaagtaagtgctacatagcctttctttttgcacagcctgagggtccagaatccagactgaggctcttgcttcatgccagtgcccctctgcacattttccatacaaactcctaaatcccatccggttccttcgccaacatccacttcaaagtaacgtcttcctgaggtgaagccttcacaacccaagacacaggggaaggcagtaaatctcctggaagatgtgtcctgattctcctgggtgtatccacgagtcacttgtctccgatcctcagagagaattagttcgtgatgagctgtatctggatccagagtcacactaactgcaaaacaaaacaaaacaaacaaaaataattttgttgctgtgaagaacacaggttattttattttattttattttgagatggagtgttgctgtcacccaggctggagtgcactggcactatctcaactcactgcaacctccacctcctggattcaggcaattctcctgcctcagcctccggagtaactgcgactacaggtgcgcaccaccacaagtggctaatttttttaaattttctgtagagatggggtttcgccatgttggccaggctggtctcaaactcctgacctgaagtgttccacccacctcggcctcccaaagtgctggattacacaggtgtgagccaccatgcccagccacaagttattttcaataaaaccagcctgtgttcaaacccaactattgtttcttataaactgggtgagcttaggcaaatcatttaactttctgagcctcagtttgttaactataaagtggaaattaccgtatttgttgcagagaatggtgggtaggattgaataagcttatgtttgcttaatgcttggtaaaattcctggtacatggtaaccacctaataagtggtagttgttggggtgatcaggcccaacaccaggccgtgggggctacaaagtccggcggggtcaaaggaatgagaaaagacaagttaagagtgcataaagtgggtccagggtgccagcactagattggaggctgcaaaggccctaagctctgggagcccacactatttattggtgatcaaacaaagaagcaggtggtgaggacgtgagggtaaacaggtgagggcatgaggacatgggggtagaaaggtagtggtgcattaagcgtagctgtgacagtttagcattttctttgacacatgtagaatatactctgctgcttgagatagtagaggacacgtttatgagtgaaaagcaaggaaccaacaagtctgtgcactttccagaggctatgaggggttttatgccctgagccctgggttccatccaagccacaaggggttttatgccctaggcttagatttgtggtgcggcagggcagccttccaccatttggcacagagcttggtgttccaaaggccacgaggggttttggaccctggaccccggacatcttccaagactcttttacattatgacagacaagccagtcctgcttcagctcttctaacaacatgtagtaataatgatatcatcaacatcatcttcgtcttaattattcaaggatgccaaggtacagaactaacctgttaatatggttaccatcctgtccaaagttcttctcccatgcaggacttccaggaatcatgagacagttgagcagaaagataccttttcccttctctactgaataaccaccaacattgagaatcagagagggaaaatgactcagctaatgtcttagcttgttattggaagacccaggtctcatgacacatgcctagtcccatgacttttaattgtaagctcttctctttcccctcagataatgttccataagcattagtatgagataataatacactgaggaccaatatacatgaaaaatatcagactagaatcaaacaagacagaaaaaagatctgataacctaaagtgagatactgaacagtatgcagttttaaaaataaaaaatggtaataggatgttctaacaagagagttaagaaaccactgtgctactgagttaaatgttgatcagttggtctgtgacaattaaggaattcaagtattcagaaacacttcctgtgctggatgctctctgtttgttcttccaaataatccctcacttttccctgtcttgctctgtgcccaggaaggctgacatggacagattaaccaggctttccgccctctggcttggttcagccaatgggaagcaccagaggagaccatagggcacaaagaagcagccttgggagtattcagtaccccagtcccacgctatgatttggagggtctgcattcctctgcctctgggcacactctagtatagttacagctccctacacctgccacttgaggcccagaggaggtgatggctctctaactgttcctagttctgggtgcttcctgttccttgtggatttcccaactcctcacctttgtaaataccctcctttttcaaactctattcagttagcttttatcagcctgactcacagaagtttggggtttcaattcatattacctgaatgacccaggaaaacccatgttgagaaattaaaatgtttacggggtggtaataccacttaagagaaaaaatatcaattggatttttaaaattccacctatctattggtgtgacacatcaacaaaaacatatagaaagattggaagctaaaagatagataatatagtcatatactgttatagtattatatcaaaagatattaagtcagagcattattaagaatggaagaagggccaggtgtggtggctcatgcctgtaatcccagcactttgggaggccaaggcaggcggatcacttgaagccaggagttcaagaccagcctgcccaacatggcaaaaccctggctctaccaaaaatacaacaattagctgggcattgtggcacatgcctgtaatcccagctacttgggaggctgaagcacaagaatcacttgaaccggggaggcagaggttgcagtgagctgagatttcgccactacactacagcctgggtgacagagagagattctgtctcaaaaaaaaaaaaaaagaaagaatgaaaggagtcacctaaaaaagataacacaattttaaacataaatgtactacattattagtgaattcatgtttagaattgtgttaatatacaaagcaaaaattgtagaattataggagaaatggacaaatctacaatcatcatgggatgttttaacattcttctttccataattgatagatcaggcagaccaaaagaaagaaataagggaagatacggaaggtctgaacaatctaagaagcgcaatctcatagtcaatacataaagctcagcaattgtttaataatagtaagcagagaatatgcagttttctcaggtatagatggaacatgcactaactgagtaaatactaggcagaaaacagtctgaacaagtttcaataaatctgtattacacagatcattttctctagcctcaatataagattataaaccaataataaaaagatgactaaaaagattctaaatattaggaaatgtaaactactaataagtcattagaagatgtatagaatggaacaataataaaatgttatttataaaaatatacaatgaagctaaagcagaattttaaggaaaatttgtaggctttaaatgcttatcttagaaaaattaaaaagctgaacattaatgagccaagcatctaatttaaattttaaaaagaacatagaaagccaaatataattttttaaaaagaaaaaatagatattaaacaatataacagtgaagttaaagaaaacaagaatgcaataaagaggaaaaacaaacaaaaaaaaaagtagcttcttttaaaagaaatttaataaaatagacatacctccaatgagatttatcaaagtaagacagaaggcacaaatggaatgaatacagaaactttttaaatattacagaactttataataaatcttatgctactaataaaattgaaagtactgataaaattattacttcctagaaaaaatatttctgagtaaaactcactcaaaaaacaaataaagcatgggcagacctaacattaaagaaatgaaatcactactttaaattttaccgacagataataaaacgtgcatctttatcaagcaaaaatggaacttgtcagttttataggaaatttagaagtcaaggcatgagtaatgccaatctcataccaaatcctacaaagaatagaaaattatggctcccgcttatagacatagatatagaactcctgcacaaaataatataaataacaaaccaaattttatatttgcaactatacatattatatgtgtatgtattatatatgttaacatatacatatataatatgtatagcatatgttctacatattatatatgtatagtgtatgtattttacaatatataaatgaaaacccaatctttaatatattcatctagattgtcatatatgacatatataatacattacatcaaaaatgtgtacaataatcaggccaggcacagtgactcatgcctgtaatcccagcacgttgggaggctgaggcgggtcaatcacttgagtccaagagtttgagaccagcctggtcaatatggccaaattccatctctacaaaaaatatgaaaaattatccaggcattgtggtgcacaccaatagtcccagctactcgggaagctgaggtgagaggatcacttaagcctgggaggtggagattgcagtgagtcgagattgcgccagtgcactccagcctgggtggcaaagggagaccctgtctcaaaaaaaaattaaaaaattagccaggtatggtggcctgttcctgtagtcccagcaactggggaggctgaggtgagaagatcactttagctcaggtggtggagccatgatcgcaccactgtaccactcggcttgggcaacagagtgagagcctgtctcgaaaaaacaaatatatacacacagtaatcaatatatatattatatgtaccaatcaatgcttcacttttatatataatatagattacatcttattagatatatagtattccttctccatagatagatagatacagatatagacatagtatcctctatccatattagagagaggatactatatatatctatagcatatagagatgctgtctcaaaaaaatttaaacatcagccagatgtggtggcccatgcctgtagtcccagctactggggaggctgaaatgagaggattgccattgatcctctcattggttgagccataatcgcactactgcaccactcagcctgggagacagagggagacctgaggtggaaggatatagatatagatatataaataaatatgtatagagagaatataatatatgtgtgtatgtgtatatatatatattatgaagacactgggagagaatactatatatatatgtgtgtgtgtatatatatattatgaagacactggtgggatggtttcattaccaattggaccaagagtccaggtatggagccaacatgcaatgttgttgttgactgagctggcagagcactggtcatagttacgggaaaagaaggtctccaatgagacatacttaacaaaatatatgaacttgccatatacgtggagagttctggtgtgtatatagccttctctcaccaacctagcaattgtcttcatcatcattataatgctatcagagcaaagatgacagctaaatttttttgtccctttcttcttctttctcttccttcccctcccccacctctttctcttcctcctcctccttcatctctcttctttttttttttgagatggagtcttactctgtcgctcaagctggagtgcagtggcacaatctcagctcactgcaacctctgccttctgggttcaagcaattctgcctaagcctccagagtagctaggactgcaagtgcacaccaccacacctggctaatttttgtatttttagtagagatagggtttcacaatgctggccaggctggtctcaaactcctgccctcaagtgatcctcctgcctcggcctcccaatgtgctgggattacaggcgtaagccactgtacccggcctcctcctttaatagacagggtctagctctgttgcccaggctgggtacagtggcgtgatcatagcttactgcagcctcgaactcctgggctcaggagatcctcctgccctagtctccccagtagctggaactacaggcatagcacacggggctaataaaattaattaggtgataaaattcactgcccactgatgactaagctctttggacataaaagacacagaccttgaaggaaaatgtgtctacttaattttgaaaccctatttatcaaaaaacaggatgaaaatgcaaaatgccatccacatgccagaagatatcagctataataagttcccataaatcaataaggaaaagaacccaataaaaattattaaaccacagtaaatcatgggtaaatcacagaggcctgaagggctaatggacatacaaaaagaatctcaatctcactagtgaaatcagaaaagcacaaattaagtacacaattaggtaccattttaaatctgtaagactgtcaaaatcataaattatataagtaaagactcagggagttttggaggagtgagagctcttatattgcttgtggggtagaattggaacaatttcaagatctgtagtatctggtaaaattatgatatgcatccctcacaccagcatgtcactccaaggtatctccctggagggaacatttacgggacacaaggaagcatggataagaatgttcacagtagtattgtctgcaacagcaacaacaacaaaaaaacccaactacacacaacttcaatgcccagtccacaaggcaatggattaaataaacttcaggccggagatggtggttcatgcctgtaatcccaacactttagaaggccgaggcgagaggactgcttgagcccaggagttcaagaccagcctgaacaaaataaagagatagtgtttctacaaaaaatttttaaaaaattagccagacgtggcagtgcttgcctgtggtcccagctactggggaagctgacgtgggaggattgcttaagcccaggaatttaaggctgcagggagccatgatggggccattgcactccagcctgggtgacagagtgagaccctgtctaaaagagataagtaaataacaactttgcattttctgccacattgcaaaatggtgagagagtggtttctagactctagactctttctatgactaccttctagttatgagatcctacaacactcacctaacctctctgtgtcatatttcctcctctataaagcaaaaatgccccatatagagaggactgtgatataaaacaagaaccaagaaaagtaaagcttttctaatctgtcacagactaaagagtgctcagtatatgtgagtcattattcctggtgctggtaggagtgtatgttacaactttgagtcaagtaatatggtaccatatattaagattaacaacaacctcggcaatcccagtttggggtatgttcccaaaagaaatgaaagcaccaggatataaggatgcatggactagaaagttattgtagcaacattgtaataactaagttctaaaaacagcctgaagctccatcagtagggatatggttacatatatttattatattcttatggaatattagacataaaaagtaacgagtaacatagaagagacagtgtatatatgttacgtttgtacaaacttagggaaagatatagatcaccctacctagagaagtcagattggagaggggtgggaaaaaccttgaactttctccttatatcctttatattgtttgactgattaaaatgtatttgttgcatctgcttgaaggcaatgtaaaataaaataaacatacatttaaaaataaaaataaaatttattcctatcacttttgtaataaagctgggcacagtgactaacacttgtaatcctagcactttgggaggcagagacaggcagatcacctgaggtcaggggtttgagaccagcctggccaacattgtgaaaccccatctctactaaaaatacaaaaatcagccaggcatagtggtgcgtacctgtaatcccacgctacccgggaggctgaggcgctggaacccaggaggcagaggctgcagtgagctgagattgcggcactgcaagccagcctgggtaacagcgagactccatctcaaaaaaaaatttgaaaaaagaaaaattttaataaacagtgtttaagaggggagaaatatttagttaaaagataagcccatttaagaaatagtttcacttgacccggaaggcggagcttgcagtgagccgagatcgcaccactgcactccagcctgggcgacagagcgagactctgtctcaaaaaaaaaaaaaaagaaagaaagaaagaaagaaatagtttcacttgaaccatattatgattccttctgtaaaagatgagagtaggcaaattgactcagtgaaatcccagcaaaacttacacaaagtcttgttcttccttcctgtcatctgtataggatgaaatacagagtgcttttgggttttgttgttgtttgttgttgtgtatttgaggggaacacaggtctataattccttttctgaaatccctggaacaaaatgggctttgccattcaaattagtttagaagttataaaggcaaaaaaatgcatatactctaaagttcaaccccatcatggcctaaggcagagccctgtaatcaaattcatcaatatatctgcagcaaaacatttattcaaattaagtgggataaataaagacttttaaatagtctcatctcagtgccgttcagggttggccactgtggaagacagactcaagggtggccttctatgattcctgcctcttggtgttcacaccctcgtaaaattccttgtctttgagtgtgagcagggcttatgaattgcttctgaccaataggatatggcaaagatgatgggatataatttctatgattacgtttcattatgtaagactccatcttgctggcagattttctctaaagagtctgtctcctgagctctctctgaagaaataactggccatgttagaagcccatgtgcaaagagctgaggggtggcctgtagaagctgtgggcaacctccagccaacagccagaaataaccagggccaaagtcctgcaaccatcaggaaagaaattctgcctgctatctcagtgagcttggaagtggattcttccttagcctagcctccagataagaacacagcctgaccaacaccttaactgcagccttatcagaccctaagcagcaggcccaactaagctgtgcccagattcctgaaccacaaaaattgagataacatatcagtgttgtattaaggttctaaattatggtaatttgtttgtactaatagataactaatataaccaccaaatcatttcaggttaggccagatttttgtagccaaatgaatcatgataaaactttccattttcaggggtttttttgattttgtacttacggatacaaatttgtgaaagtatagtcagcactgatttaaaaaatcaagggagcaggaaactcagtaaatggttctaacattttggaatctgtaaattggttgtaacatttgtcatctgtgttatctaagtcaagttcctaaaatatgtgaatgataggttatcatactcacctacttttcttgcattgctctaagagttggctgagctattgataataaacactatgatcagatctaataccatgatgtgctattatgatcatgtgtcagtcacagggctaagcactttgtacatgttgatgcatttaattttgatgataactcaatgaagtaggagctgttaatattttcatttttcagagggggaaaccaagtcacttggagtaacatggctaataagtgaaagaataagaatttgaaaggtttgcacagataaccagaatgcaatgctcatcacattcactgagcagtgaatcatactaactagagaaagtatgaaagctctactgaaattaactaaacaacctctctggctgtgagcctgccaagggacaggtggtaaacttggttactgcataaggccccttctatccacagtattcaggaattctttagtgaacataccttgatgactccttaacattttcttcacatcgaagtaaagcttggaaacattgcacatagtatgaagttccaaggagacagcctctgatgtttccagcttcacagcccaactcctagaataagcagaggcgagagatttcttcagaggtgcattccattcatttctatatacgcacacccctcccctcctgcattcaaacaggacttacctgctcaaagtgtcattcacattctataaagaaacaaaaagaaaaggtgagcatgggaacatcggtatttcatggggcttgtcatgcagggctattcttctttgctttacccgaagaagtaaagagagttaccctagtcttagtcttagatattgatggatactcaaacaaagtaattcccaccagtcttaggtattgatggatacccagatggaataattcctaccagcttctgggagattcagcatggcaggatgtttatcaacatttgcatctattctcatccttgctgaagtctgagggccaggagctttgtccatgctccctctgtaaggactagcttttggtgatcggatttccttcacagtgagcccagattagagaacacttatcataaaggtccttagtggtgaatctgtgcacagccctgagactgggccactgccactaagatggtggtagcaggtatcacacagtggtaaagcaatcatgctatacactcagccttacagtatagtcaccaatcctgttagttagaaccagaattaatggctccagatgtttatcttcctacagataaagctgtagattgtaccataacagctctggagcaagggttctacaagcaaatcagggaaaaggttatcactcattttggctgccccacttcatcacccatcagtcacctagtggagtatttcaggagagagtcaacaaccagggttctctgcacatgggccaaggaggcaaacagtggtaaatgttatcccgtggtttcatttggccaagctgtgttccctcagaagtttatttttctaattgacataaaggtaccctataaattagtgaaggccagcctgatggcactgatgtacatctaaaagaaacattactttatcttcccatgcttccttaccattctcctttaatagcactataacataccttttttccctactccaagtacacagcctcacctgcagcaatttctgggctgagccctgacatttttcctccagttccaggatgtggctcttgagttcattgctcttcagccccagaccagcctcatagtccctcagtctactcagagtctgttgttcttctttctccagcctccagagataagacttctcttcctcatgtaggaaacactggagattcttaaagtcagaccggattttttgtctctgaatctgtaccttctcctggagtcaagaaagtatggtcaaaaggtggaagtaaaccaaatgtccatctatggatgaatggataaacaagaatgaaagtctgacacacgctactacatgacaagccttgaagacattcaagcaaaataagccagaaacaaaagggcaaatattgtaagactttgcttatacaaggcatctggagtagttaagttcatagagacagaaagtaaaatagtggttacaaggtgttggcaagaccagaaaatggacagttattgtttaatgggtagtgagtttcagtttagaagatgaaagatgaaactgagttgcagtttggagatgggaatggtgatggttgcacaacaatgtaacaatgtaaaagcacttaattctactgaactatatacttaaaagtggttaaatgcttaagtgttatatatattttcacacaaacacacacacacacacaatcagccactgggacattattttctcatgagtcactgaagctggaagaatgtccccagtttcctgctgcagagtcatgtgtgggaggcaggcactcagatgtggaagaggttgcctcagattccttatagtcacccaattaattttcttgttcttcagccaagacacaggagaaagctgggttaggagtgctagataatttaattgtgaaactagggccaagttcaaacactttatcagttacaaggataaaaagaggtttttacttatgatttaagaagttagatttctgagttggagcgattttcttgaagtaaaagcttataatgaacatcacccagactggattttaagacaaccaggctggtaagagggtccataattcttggcagggggagctttgagtgtgacaggcatttattatggttaactgagaaatactgttctactaccctagggtcatcttaagcattcctatgtgtaagactgacagaaatcaagtgaaactctcatctgaggagatgtaaagttgcaatttccattagtgctgtctaaattaatgcagtgggagtgtgtattcagggcaatttgaatctatgttcttggattgcagtcttcaaacttggcccaaataaactctctacttatcttaaaaaaataaaaattaaaaaataaaaataaattcatacagtgttttgatgactatgatatagaagaagggtctttgacttaggatgaggtggaatttttgtgtaggagacaggtgcagctttaactcttgtatagacgggttttcatatatgttagttacaatcaaggtcttccccattgcccaagatcctagaaatgggggaagtaagagtgtactcaggagctcaagagcaacatccacaaacaaagatcagggtagaggttagagaggactcctgaaagagagaaaattggtaatcagcttgtgggattttactgcaagctagtgaattatataaatataaagattggtgcaaaagtaattgtggtttttgcctttactttaatggcaaagaccgcaattacttttgcacaaacctaaatatttccataaaagaatgtggctctgataatgtggaggttagtcagccacggaaataatctgaaagtttgtagttgcaagtgtgtaggttgttgcattacttgtgatgtacttataaatcaagtataggccgggtgcagtggctcacgcctgtaatcccagcactttgggaggctgaggtgggtgaatcacgaggtcaggagatcaagaccatcctggccaacatggtgaaaccccgtctctactaaaatacaaaaaattagccaggcatggtagcacatgcctgtaatcccagctactcaagaggctgaggcaggggaattgcttgaacccgggaggtggacattgcagtgagctgagatcgcaccactacactccagcaagactccatctcaaaaaatagtaataatttaaaaataaataaataaataaagtatatttctttcatcagcttcatgagcttgagtagtatgaatttcaatctggagtgatcctgttttctaagtgttcacaaagcttggtttctgtacctgtaaagttgagagccagatgctccactgtggtaaaagtgccagggtaatgagttgaggcctgcaaaccaggtttattttgaggtatttaaagtttgagacccactcgatgctttttctaggtaaatagtcatactaattctgcttcttctgactgaagtatcaggaatcccagccaactacagtttaaagatggaaagattggtgctaaatactcatggatgtaaacctggaaccaggggcataagtacaaataatggtttcttccttgggtttcattttttcaatctggtttagtgagaataaatcctcattgtgcttttcctcaatcatcccctatgcctaagctctagaatggaaaatagcttgagatcaatgaagtcagattcttactttccatttagttattcgcattgctgtggacagcttctgctccgtacatctgtcttcaagttgcttcagttttgtcacagctttctggagcttttcctgaaggaaaaatttgataagtgaagcctattcaatttgactcttcattagggacctagggggaatcccaatcttctaagatatatttgaataatagtgaatatttatagagtcctcattgttttttgctagagagcatgctaaaggctatatgtgcaggaacatactgatccccttggcaaccctgaatagttggtaggattttaaacttcatttctgtgctgtagaaaatgagactaagaaaggggtaaaataacttgcccaaagggctatgactgccaggtggtggagcaacaattgcaatctcatctgctgacccagagcctgagctatgtccaccactagagtcctgccaggaaaaagttggatatagaacaaggtaatcatcatctaaaagattttgtaaaacaacatgctgaaccaagcaaaaccaataccagtgtttggcacacatgaaattttgtgtcttatgagtcaggaaaaatcaggatgccagctggttattagaaacagttcatggaagaggggaattctggtatcttttgaacaatggtatcatgaatccaatttaaaatgatttagtattcatgtcaagcttttagcttattcttcaaaacagtttctcatatttctattgaaagtgatttgaagctgacccaaattgctaattgtagtcaatgctgaaagaattgtctcctgtcctctgtaaacccaacaagtatactcattcattctcgagtgttctcaggaaaaggttctatgtaactgttttagcaaaagatgacattgtccttactatatgccaagtgctattctatgcattctatattttaatgtcctcaaagcttataaccacctcctgtgtatgtgttttagggagggaggacactgctattatccccatttacagatggagaaaccaaggtgtgaagacattaagtaacgtgcccaaaattgcccatctagtaagtgacaaaactcaatttcaacataagctggttccttttcttactacttggtggaaaagtaattcaaatgggaatatgatcatcgcagttattagctgctccatggagtttaaggaagagctgccatgagctgagtggtggtcatgattgacatgtccttagaaggacttagagccttcatacaagaccacctctgcctcatggaggacagaataaggagcctgacactggagacaacattttcctcaaatttaggcaggacagagaaggaaaaaggacatcaggactatgcccattcctccatgctgccaacagcaaagtcccaccttccttaatatgctttctggcaagaaatctggatggtacacaaaacctctccctctgcttcaccttccacaaccaagcatttccaaatctttgactcttcttcctgaatcgtgcttaaaatctgccctctcctccctttcttatacggatagtttgaattttactccttgatattccttttatcatagacatgccacagtagctgggcacagtggttcatgcctctaatcccagcattttgggaggctgagatgggagggagaccaggggtttgaggccagtataagcaagaaaggcagaccatgtctctacaaaaaataaaaaaattatccaggtatggtggggcatccctgtagtcctagctacttgggaggctgaggtgggaggattgcttgagccccagaaggttgaggctgcagtgagccgagattgcaccattgtactccaacctgggatacagagcaagaccctacctcagaaaaaaaaaaaaaaaaaaaaaaagtagaggtaccagagtgatattttcaatgtcactgacccttcattccccaaatgaaaatcccccaataggtgttcaatttttacgtgtccttcaggagttacttctaagatgaaccactctctaccctaaatgtccctccccaccaccaaaaccagggacctccaggcagacatttttgatggtttgttttctttactagactgtagatacctaaaaggtgatgggtctttcttccctgttttcaggccctactgcatggctttacatattgtggtttttcaaatgatattcatggtgtgaaacaagaaaaaatgcgggtgtttggtttgagaacaacctgttctaaagcaaaaagaaattcatcataacacaaatggatagagataagagtccaaccatcccattgaaggtcaggatggacagtctagataattgagcaagaaatcatcataaactatttttcagaagaatgacatgatgaaagctgtatttccaagtcataatgttaggtttcaagttaaatcatctcagctcctggggagcaggataagacttggtacttaccaaagctcccgggcccacacactcaccttgtagccctggcatacgtcttcaacaagagctgtggtgtgccctttgtgctgtggtgcccgctcacagcgccagcagatgagctgcccctcatcttcgcagaacaggtggaactgctctccgtgttcctcacatgacatttcttgatccgtctctttgagggcttcaatgaggcttcccagctgcttgttgggtcggaggctatccatatgaaatggagcccgacactggggacagcagaatgtctcctgcctcagttgcttttggcttgggtttttaaagaagtctgttatacacaagtggcagtagctgtgtccacagttgatgcttactgggttcgtcatcaggctcaggcagatggagcaggtggcttcctccatcatcttcttggtgctggtggttgaggccatagcttttattgaaaagctccaatattggctctagagatggagatgaagcagccagaattttccaccgtgatgaaaatacacctcacctgcacctctatgtgatgagctggctgcaactgacttccataggtcttgaaggttttccttccaacccctattatctcattttgtattgaagaaaagaggacctaaaaggaagaagttgaggctgaggttgtttgggccacgtttgagaactgcaacccaagtgcagagtttcaagttgccctcattagcaagcagttacaagtggttgtttagaggaaaaaaagcagttttaaagcagttttaaagttgtttgccaagaatttacattaaaatagcataagcttttgactggctatacattgttctttgtattacaaatctcgggaatatgtaggtaatagatgaggcagccagtcaggaacaaaatgcttttaaacatggggtcttaactgaagacctatactcctgcctcacttgtcctgataaattttgcatacctcacatagctcagactgctctaaattatttcattatttttcttttctcagtcttctaacttttttttttttttttaatgagacggagtctcactctgtcacccaggctggagtgcagtgacgctatctcggctcactgcacctccgcctcccgggttcaagcgattctcctgcctcagcctcccgagtagtagctgggtctacaggtgtgcaccactacgcccagctaatttttgtatttttagtagagatggggtttcaccatgttggttggctaggatggtctcgatctctcgaccttgtgatccacccgcctcagcctcccaaagtgccaggattacaggcatgagccaccgtgcccagcctctttttcttttcttataagacaagttctcgctctcttgcccaggctgtagtggagggcagtggcatgaccacagctcactgcagcctcgacctcctgggtttaagcaatcctcctgcctcaccctggcagagtggctgggactacaggtatgtgccaccatgtccagctaaagtcttctctccagaaagaagaaatgcattggaatttagaggatacacaaacatctagctgtatagctaatacagtagccactatcatgagtaggaatttaaatttaacttaataaaaattaaaatgaaaaaattcagtttttctgttccagttgccacattttgattgcttaatagttgcatgtgactagtggctacataacagcctcaatatacaacattctgttatcacagaaagttaccttggaccaagtgctgggagaagcaatgcaggcttcctcacaaaagctgtaaaagagagaactcagggagtgtgaaactctttcctattctagttaacttcaagaataattgttaccaggccagcacggtggctcacgcctgtaatcctagcactttgggaagccgaggcgggcagatcacctgaggtcaggagtttgagaccagcctgaccaacatggcaaaacctcatctctactaaaaatacaaaaagttagctagatgtggtggtgcacacctgtaatcccagctgctcaggaggctgaggaaggagaatgacttgagctccggagggggaggttgcagtgagcccagattacaccactgcactccagcctgggtgaaagagcgagaatctgtcttaaaaaaaaaaaaaaaagaataattggtaccagaattactctttgtaattagtagtaacacttatgcaattgggtgatctgtgacagattccattgaaggagtatggggagcttcaccccaatatatgactccctggtataatgagtattttgaattaaaggcccttagagatcagcagatgctggaagagacttttcccctatctacataaagaccagtcacactagacaagaagaacaattgtttttccttccaacccctattatctcattttgtactgaagaaaagaggactaagaatgtaaccagacctaatcagacactttcacaaaataatgtctgtctctcaggctcattcattttccaaagagaaccatttacaagttaaactctgttcctccattcattcatcctcccaaatattcatttattctccctagtaatcatttactgcccctcaaagaattacctatattctcctgatatcacccttcccctctgaaataaatatgtatacatgtataaacgttatacatacatatttatacagtatacatacatatttatacatacatacatatgcatacatatttatatttatgtatttatacataagtatttataaataaggctatataagtatctacccccattggcagagggggtaatcactctgtgattctagcccatgtacttgttaataaatttgtatgccttttctccaattagcctgccttttgtgagtcgatttttcagtgaacttcagaaggcaaaggggaagtgttcccttggctcctacaccatcatgacaataaaatttgactccacctcgaccccccccatcccccacaaagaacaacaaccaacactggttaataaggtcggttgttttttgtttgtgtttttgttgttgttgttgttgttgttgtttttgctttcaggagcagaggtataataggcaaaagaaagagaaaggagaatagtgaatacctcttctgcagagaggggtgcctaagtgggacttccctggctaataacgtcttgctagagacccaaccaggaggataatggaagcaatcaaggcaaccagaacaaccagaagaaccagtttatcctttttgtgccctctccctaaactgagggaataagaattggaaagaaggctgcagagcagagggtttgctcctgaggagcagttatttctatgggatcagagctcctgcagaactggggagtttacttttactatctcttctccaggacaggacctatctcaagagacatgttcagagtgattgcaacataaagagtttgcagacccaaggaggtagggaaggcagaaagaagatgggggaggccagggataggcaacagaggagtgaccaggagcgaaaaagcctgcctcttctgagaacctagctgggctctccctgtacccccgatccctcccccccgcccgcccccacacccctactcctgggagctcctctaggacaggggcagagtcaggaggaagtttgaagagtgcctagaataaaaaacagtaatttaactacaattaccgggtaggctgttttcctctcacaatttgatcagtctcttgaagccacacagaatttcttctgaagacgtgtattccttggcaggctatttcctccagtgatacaccaggcccctctctgctggggtcactgctcttctggggagatggggctcccctccttccaaggctccagggttcctgtcctgggccccactcatctaagttctgaatcttctgagatttggtgtaaagtctggtgaaagaaagagcaggaaagaggtgagagctgtaaaacaaagaaagtcctgaccattttcagagttggaggggccctgctgtcacgaaatatattccccaccccacttgccatcagtacacactcacatatccactgagaaaaccttagcctggaccttttccgtaaccttcactgctcagacacttacatattcgctgctagtcccctctgttgctgccacttcctgggtcaggaagttaactcagaccggattaaactgagaagtgaaactactgtgggaggcggggctcataagatttaggagaaaactagtgacgttgttcatatcatttgcactccgcctctccggtaaaggagggggaaacgtaggaagaaaatatccttcttttacagcaataaaaagaaggaaccaattaataaccctgtaaactatcatgtgaccccaacacagagtatctaaaaacaggaagcctgcagaggttcagttcacagactctgatttgagatctttctacttttgccaccaactcccttgggagtccttaagccttcctagctgatgttacttcttttgctatttatgggttgcttgtggttctataactgctctgaagggtgtggtggaaaaaggggtggtaacagcagtaggactcattggcatcacaaaattcatctgagtcagctttctattcttctctgtcccgttctgtgtcttgtttttctccttgctgtccttctgcaggactcagatcttcttcaatagcgagggtcagccaggatagaaaatgggagtcactagtggcccagcagtgagtgcccccagcttagagctgtgtgggatccctgggaccatcactctgctttgtgctttgtggagaaaaggctgtggggtccagggtcaagtccttaatgacttagctccagcttctccacttcaaaatgaaaggaaaagtactatcaccacccgttagaattattatttcatggggaaaaaagatggattactatctcacaataagagcttgtcacatttataagtctcaggtgtaagaggcatttatgataacaacataataaatgctggcttaagtagatgcagtggtccaagggaaccagtaaggggagctcaggacacaggtgggaggagaaattaaacttgaattctgggagccactggcctgtctgggcccctggcctgcctgctgaccctgatagccaatggaacatggagtttggcccagctgcaatccctctggtccaactactcaaaataaaggcaagattgggaaacacgttcctttcttcctataccaagcagaagactcttcagcactgcaccctcctgggtgctcacagagccttctgttgttttgccacctacgattcatcatgccctggcatgatggttgcagaccccatgcatagcatgggacattctactcctgaggcaaccagcacacagagagaggagaaagaatgagcccctgaatccttggtcccacgatgagtccttgcagatatctacaactttcattgttgtggatgtgactctgtacccaggcatggctcattccagatctgtcctattgtcagaggtgttcaaaccagaatgactccattttgaatgggggctaggtaaaataaggctgagacctactgggctgcattcccaggaagttaggcattgtaagtcacaggatgaaataggcagttggcacaagacacaggtcataaagatcttgctgataaaacaggttgcagtaaagaagctgaccaaaacccaccaaaatcaagatggcaacaagagtggcctctagtcattctcattgctcattatacacgaattataatgtgttagcaagttagaaggcattcccaccagctccatagtggtttataaataccatggcgatgtcaggaagctaccctatatagtctaaaaaggggaggaacgcttggttctgggaattgcccacatctttcccagaaaacatatgaataatccactccttgtttagtacataatcaagaaataactgtaagtatctgtattagtccattttcacactgctgatccagacatacctgagactgagtaatttataccaggaaaaaatgtttcatgctcttacagtcccacgtgtctggggagacctcacaaccacagcagaaggcaaggaggagcaagtcaggtcttacatggatggcagcaggcaaagagcttgtgcagggaaattccttcctataaaaccatcaggtctcatgaaacttattgactatcatgagaacagcagtataaattactcagggaaagacctgcccccatgattcaattacctcccaccaggtccctcccacaatatgtgggaatttaagatgagagttaggtggggacacagccaaaccatatcagtatccttagtccagaagctgatgctctgcctgtagagtagccattcttttattcctttactttcttgctttcactttactgtgtagacttgccccaaattctttctcacacgagatctaagaaccttctcttagggtctgggttgggaccccctttctggtaacactatcaaaggatcaggaaaaggaagctagtgaatgctaaaaaggaaacaaactaccattaccaataataacagcaagacaaaagcaaaacggattgtgacagctgtcccatctcacacctgtttcccattgcaggaaggaggggctggttcatgcacagagtggccaatattagaagcagagagggggtgcagatgagacttcaggaatatgttgacaaaggcaggcctagggagaaatcaacctgaactatccccaaggaggaatgcattatctctaatatgtaaagttaggcttgatcctgtgattatgggatataggagtccaaagactcacaatgggaagtaggtcactagagtctccttcagaagctctgtactgtgtgttcccactgtgggcaagagtcagcactcagctattcctagaatgcctttcctcaactccttcagattttgcctctcaactaaccctatcctgaccacttgttagcaagtgtacccctctctccctcccaaacattttcaaatctattttgttcccatggcacttatcactgaatattttactaatttattttgtttagtgtttgcttccctcatgagaatgcaaagggatggatttttttcaatattgttcactgatgaatcccagtaactagaatatttctaagcatagtgatgtgcattaaatcaaagagtaactttctgaattgcactaaacacacatcacaagaggtgtgtgcacatatgtgcatgatgcacgtagtgtggtgtgggtgttgtgtggggtatgtggtactgtgtgtgctgtgtgtggtatgtgatacatagtttgtgttagtgtgatgcatgtgatgtggtatgtgtgtgcgtgtccatacatattaggggtggcggggatgttaatatgtcaaatggtactagaaagtatcagaactcatggtgcttactggtttcccagagagctgcttctctcccacctgtaggatatactgatggtttggacagagaagaaataaaaagaaggctgtgacctactgggctgaggaaataaaaacgaaagtaaaagaagagctgggaaaagagagtggaggggccaagggaaatttcccctttggcttctggggaaactttgctgaaaaatcaactcacaaatttattaacatgtacacagggagaaccatagaatgattatccacttcccaagagggcttaaaagcttatatattatcctggcaaaacagattatgggaggggaagaagagaaactctgttgatgggattactgttgcggatttttgctccttcgctcagctaggtccgggtttttgtctcacagccaggaagaattaggcatgcagccatcaaagaatgagtggagtagaatttattaagtgaaaggaaagctctcagcaaagacaagggtcctgaaagcagatttctggtttgctcttcacagttgaatactagggcttaagactcaaattcctgacaactccaccctgtcctaccagtgcatgcaggcctttagactgagctactccatattgattaatttcctgaactgcgcatgtgttaaggaaaggaatcatccactgcaggcatgtttaggcaagccccctgtgcaagttcccttatctgcacaaaacatccggtgtaagcacttgtggggcaggtcagaggttctctgggtaccattcccttactgtctgcctaaagcaagctggccaactcctttcattactagggagagtaagtagatcagggaacagagattaacttgaacattatcttgtgaaagtccgttcgggcatggttacattcttggtcttacaggaagggtaaataaaaataattgctctttttggtgggtctggatcttaggtagataaagaaactttaattccacgatgtgttttggtagggatagttggtggcagggatgtcagagagactttgaggcttcttcagttcaatatgaccaagggccatatattagggtatcaatttctgagccccaacaagagcttaggagagatgtgatagcatcacagtgtgaaagcaattttttgtctgtttttagagacaggctcttgcactgtcaccctggctgaagtacaatggtacgatcacagctcactgtaatcttgaactgggttcaaatgatcctcccatctaagcatttcaaagtgttgggattacaggcatgagccacggtacccagcctgaaactgcacccactttctgataaacttttcaaatgactaaaggggagagagtaagcactactcagaggtaggaagaaaggacacaggattataggattaaaacaacaaccaccaaaaaaaaccagaccggtgtggtggctcacacctgtaatcacagcacttggggaggctgaggtggggggagtcactggaggccaggagttcgagaccagcctggccaacatagcaagacgctgtctctattaaaaaaaaaaaatacctgccttgagctaatcagaatcatggaccctgacaaaggatgtcccaaagtaagtcttagcattttttttttttttttgagacagtctcgctgtgttgcccaggctgaagttcagtggcgtgatctcggctcactgcaacagctgcctcccaggctcaagcaattctccctgccttcagcctcccaagtagctgggattacagatgcccaccaccacgcctggctaatttttgttttttttaatagagatggggttttgccatgttaaccaggctggtcttgaactcctgacctcaagtgatctgcccaccttggcccctccatagtgctgggattacaggcgtgagtcactgcacccggcaaagtcttagcattctttacaaacagtttgtacccgtatctctaaaagggagtagtgaatttcaccccaaaatatggcttcctgatataatgagtattttgaatgaaaaactcttagagatcaacagacactaaagagacttttccctaggtacataaaaataggatggccccaccagcgagaacaattgttcttttctccctccctgttatctcattgtgcattataggaaagaccaagaatgtaaccacacctgaacagacccttttataagataatcagtctctaagcatcatttaaattccaaggagaactatttacaaatttatctgttctttgatccaattagtctctcctggtagttacatattgcccctcaacagaattcctcttcttctgtttcccataacctattttgcaaggatcaagcccctgttacttcttcaacttcaagttggcatataagcttctaaattccactgggatattggtactatgtgcatgaggagaaccacagagtaattaaattgtaaagccttttatcttatgaatctgcctttttttgtgttcatttttcagcaaaacttccaagggcaaaggtataaaacaaaaataaaattctaaagccccccaaccatctgaatagactttctcttcagtcaggcttcttaaaatgtaacctgaaagactggctcaggccattaagggaagtgggggttgaacatgcctcattattcctctctggcattaacatcaacacagcttttaagtctgataagaaacattttacaacctattctctctgaagcctgctagctaaaaacttcatcccatagtacaactttggtcttcacaacctgttatcacaacctagtgctcctttctattaatcccaaatctttatacaaactcaaccaattgtcatcacctccaccccactcctccgctgcttccagttgtcccgcctctctggaccaaaccagtgtacatttcttaaacgtatttgattgatgtcccatgcctccctaaaatgtataaagccaaggtgcatcccaaccaccttgagcgcttgttctcaggacctcctgagggctgtgtcatgggccatggtcactcaaatttggctcagaataaatctcttcaaatgttttacagagtttggctcttgtcatgacacagatgactgcttcactgaagcctgctctggaagtgagtgggggttttgcaaggataattttccccggatagccccagaagcagctagtaataatacacttaaaggtagctaaaatgcattgaacacttgttttgtgccagacctatgtcaacatttgctttgtgccaggcttatgccagtactcctgatttgttaatacattctaaataaaaattctggagtttcaaatataataactgaaaaacagaaaataaataaaaatatataataactgaaataaaaatttactaaggctggggatggtggctcactcacacctgtaatcctgttaccggaaaggggtccgtccagatccagaccccaagagagggttcttggatctcacacaagaaagaattcgggcgagtctgtaaagtgaaagcaagtttattaagaaagtagaggaataaaagaacggctactccataggcagagcagctctgagggctgctggtcgcccatttttatggttatttcttgattatgtgctaaacaaggggtggataattcatgcctccattttttagaccatataaagtaacttcctgacgttgccatggcattcgtaaactgtcgtggcgctggtatgagcatagcagtgaggacgaccagaggtcactctcatcgccatcttggatttggtggggagcagtgaggatgaccagaggtcactctcatcgccatcttggatttggtggggtttagccagcttctttacttttttcctttttttttttttttttttttttttgcccaggctggagtgcagtggcacgatctcagctcactgaaacctccaatttctgagttcaagcgattctcgtgcctcagcctcccaagtagctgggattacaggcatgtgccaccacacccagctaattttttatatttttaatagagaccgggtttcgccatgttgcctacgctgatctccaactcctgcgctcaagccatccagccaccttagcctcccaaagtgctgggcttataggtgtgagccaccccacctggcctagccggcttctttactgcaacctgttttatcagcaaggtctttatgacctgtattttgtgcccactgcctgcctcatcctgtggcttacaatgcctaacttacagggaatgcagcccagcaggactcagccttatttcacccagctcctattcaagatggagtctttcttgttcaaatacctctgacaagcccaacactttgggaggatgacacaggaggattgctttagcctaggagctcaagaccagcctgggcaacacagtgagaccccatctctaaaaaaaaaaaatacaaaaaaattagccaggcatgatggtgtgtgcctgtagtccctgctactcaggaggctgaagtgggaagatggcttcagcccaggaattcaaggctgcattgtcagaggcatttgaaccagaatgactctatcttgaataggggctggataaaataaggctgagacctgctaggctgcatttccagtatgttaggcattcttagtcacaggatgagataggaagtcagcacaaggtacacatcacaaagaccttgctgataaaataggttgtggtaaagaagttggccaaaacccatcaaaaccaacatggccaccaaagggacctctggttgtcttcactgctcattatatgttaattataatgtattaacatgctaaaagacactcctaccagcatcatgacagcttacaaatactgcggcaatatctggactttaccttatatggtctaaaaggtggaggaaccctcaattttgggaattgtccaccccttttttggaatgctcatgaataatccaccccttgtttagcacataatccagaaataactataagtatgcttatttgagcagaccacgctgctgttctgcctacagagtagccattcttttatttccttactttcttaataaacctgctttcactttactgtatggacttgccctaaattctttcttgtgtgagatccaagaaccctctcttggggtctggatcaagacccctttctggtaacatctttctggtgaccacgaagggacaatactgaggagactctgaagccaaaggaaacagactacagcaccaactggctgactttgggtaagtggtggagtccccgggtaaaggataggattgggttagaggtgcaacttaggggagatagggtctctcctaagacagagagcgtttcagtccgctcttaataaagggcaagaatgcttgaccgaacttgggtttgagacccaacttaggaaggctacagtccttaagatttaaggggttagaggcccctctcagtaaagtctctcttggttaaaaacggatttagcattaggggatgttaactgctattctgtttgtattaatcttccctgtgctctttgctgacagctatgggtgacaggattaggcatgtacaggatcacgggacattgggaacttttcttctctccaaaaggggaagcttgacagctgataggactgttggaaaagatccctttgctatgacaagcagccgcctgaacttttgattcagtgttgctgcaatgggtgggtctttctctggcctctgtgaactcctcaccttccccacctcaccacaggcaatgcttttctccctttctctcttttctcttttctgtcttttctgttacttgagacaaccatcttgcccagagaccatatgttgaaactcctggtcagaagtttgattaaagatgaaagggcctatctgggggcaagtttgagccttcccagttagatattgggtgctaagtggagtggccaatgtctatgttttgtcacatgtatattgctctggctgaaatggaaaacgttaatttggttactttatgtggccattgggcagcatcttacaaaagtgagagacatttatttgcctgtggttccatgaaacagaaaaaagttggttttcctttgtgtcgtagcttggacccaagggctttgcagtgagcaaggttgctagcgctgctcagtgaaagagaacccagaaacctggcatgccagcaaaagggtaaagatttcttaccagtcaggcttctggcctctctctcttagtgaaaactgaatgaatggtaaaaatcactgtttatcacctctgtaaagttttgattaatgggaacaaggatttgtggggctagtcttaagctgtaatgaatctggtatactttgtgatatcaatttgtctttctgtattactctgtcataaagaggaatatggtaggatagaacatgggcttaggactccataagcctgctgttcaagccagcccagtaaactggtccgttgcaaagtttattacaggtccctggaaaaaaaaaaaattaaaaactggatgaagtttccttctcatcttgttttatgtcctttggagcttcaccttgtaaccacgtggcggtactttctcttggtctctgccatccagggaacaggaattttggggtttatgtaatagttaactctaaaaattatctcaagccattgcaagctcaaaattggctgctctggaccccttctgggaagggcaatggaaactaaccagtgttgtagctcagcagctaaggatttgtcattttataatggcggccaaggttcaatcctggcttagggaatgagtactttctgattgatatctgtgtgacctttaccatttgttgattctgttctcttcccctccacacactgtcttgagttttcctctctctgagaacctgggagattatctttggtaaagttcaaaagccagaaataatggccgtgtgggatggctaaagttgagtaataagaaacttaaaaggactccttttttttttgctttagagtgctatggtttatggttaaaagcttaattaaaagtggatattcaatctctaaaagcctgggactccttgggaaaagcagaggaggcaccacagaccccattttgggaaaacctctgttttcctcatgaaaccccaggaactggaagtggatagatccttcgcaaaatctaaggctctgtttggctttgcattatgttatctgatgtttttgacttttgggggtatcagaaattactttgcattatgagggagatctggtgtgtaataaccaggtaggaaatatacttctggggatagctaaaggcaaatataggtgaatacttggctatttgcacttttggatcacaagaagcattctcttgactacctagaaggtatggaaatgtctccatccccaccgagagataagattcccaggggagatggctgatcccccaaaagagggctgattccctcttttgggatccaggatctggtataaaaatgggaccctggccaggcacagtggctcacgcctgtaatctcaacactttgggaagcctcagagttatgaatgtctcaccatactgacactttgtgactgagctcctctctaccctggacacaagagaccctaataattagacaggaatatcattgcccctatttagtctgaagaagttatagaagatggatctttatcccactgcaatccttaggattaagggttccctggtaaaagggagtgggaaaatatgtcagaggcatttgaatcagagtgactccatcttgaataggggctgggtaaaataaggctgaggcctgctgggttaggttaggcattctaaccaggagtttagtcacaggatgagatagaaggttgcacaaggtacccgtcacaaagaccttgctgataaaataggtaacggtaaagaagccagctaaagcccaccaaaaccaacatggccacaaaagtgacctcttgtcatcctcactgctcatatacactaattatactgcattagcatgctacaagacactcccaccagtgccacgacagtttacaaataccatgacaacatctggacgttaccttatatggtctaaaacggggaagaacccttagttctgggaattgtccacctctttcctgaaaaattcttgaataatccattagtttagcacataatccagaaataactatacgtctgcttatttgagcagtccatactgctgctctgcctatggagtagccattcttttcttttatttttattttttagataaagactcgctctgtcactcaggctggagtctggagtgcagtgacgtgttttggctcactgcaaccttcacctcccgggttcaagcaattctcctgcctcagcctcccaactagctgggaccacaggtgggtgccaccatgcctggctaatttttgtattattagtagagatggggtttcgccatgttggccaggctggtctcgaactcctggcctcaagcgatccacttgccttggcctcccaaagtgctaagattacaggcattacccactatgcatgacccattcttttatttcttaacttttttttgtttttttgagacagagtctcactctgtcacccaggctagaggctggagtgcagtggtgcgatcttggttcactgcaacctctgcctcctgggttcaagcgattcttctgcctcagtctcctgaggagctgggactacagacatgtgccactacacccagctaattttgtatttttagtagagacagtgtcttgccatgtttgtcaggcttgtctcgaactcctaacctcaagtggtctgcctgcctcagcctcccaaagtgctgtgattacaggcataaatcactgcgctcggcccttctttactttcttaataaacttgttttcactttactgtatggactagccccaaattccttcttgtgtgagttccaataacccttttgtgtgtgaaagaatttatggctgctgttcaggctggagcaagctggagctcatgctgctgctcagactggagcatgcgtgatctgtgatcccagtaagaggatcatggtcactccagcctgaacgacagcatgatatctcatctgtaagaaaaaaaaaattactagagggctttaacagcaaatttgagcagcaaaaagaagtaatcagtgaactcaaagataggtcaattgaaatgatctactctgaaaaacagaaagaagacagaatgaagaaaaagaaatagagccttagagacaggggataccatcaagcatactaatatatgcataatgggactcctagaaggagaaaagtgagaggacagggagagagaatgtttggagaaataatttctcaaagcttcccatgtttggcaaaaaaacattaacttgcatacatattttaggagctcaatgaattccaagtaggatacactcaaagagatccatacctagacacatcataatcagattatcaaaagatgaagaagatgaatcttgagagcagaaagaaaggaacaattcatcacatacaaatagtactcaaaagatgtctggagtaggtatactaatatcagacaaaataaactttaagataagcattgttataataaataaagaaaggtattttgtaatgataaaagtgtcaattcatcaagaaaacataacattataaacatacatgcacctaacaacagagccctaatattcatgaaacaaaactgacagaattgaagggagaaatagaaaattcgacaataatagttggagacatcaatacctcactagttagacaagatcaacaaaaaaatagaagacttaacacttgaaaacacctaacctgaccctaacataaatctataggtcactacaccccaaaacagcagaataaacatccttctgaagctcacatgaaacatttttcaggatagactgtatattacttcatgaaataagtctcaataaatgtaaaaggactataataatagagtatatattctctgaccaaagtggaatgaagatagaaatcaataactaggctgggcgtgatggctcacgcctgtaatcccagcactttgggaggccaaggcggacagatcacgaggtcaggagtttgagaccagcctgaccaacatggtgaaaccctgtctctactaacaaaatacaaaaattagccaggcctggtggcatctgcctgtagtcccagctactcgggacactgaggcaggagaatcacttgaacccaggaggcagagattgcagtgagctgagatcgcgccactgcattccagcctgggagacagagcgagactccatctcaaaattaaaaaaaaaaaagaaactagaaaaataagaacaaatcaaacccaaagcaagcaagaggaaaatgaaaaatttcaaagcagccaagaacaaaaggcacattatgtacagaagaacaagtgtatagatcacatatttctcatagacacaatataagcaaaaagacagtggagcaaaattttttagattaatgaaagacctacaattctgtaccaagcaaaaaaactccccccaaatgagggtgaaataagacaatttaatacagagaaaagaggaaggaatttatctagtcatatgtgagagttttatgatacattttgtactgtatatgtggatgttttctatttcatttaaaaaatcaaccgtgcaattaaatggtagattgtcttgcttctttttgattgacacagtcattaactaaaatattgtagtatttttttatctccctgcctaaaggcaataaacatctaatcagcagactagaacaataaaaaatattttttaaaagtcctttaggcagaatgataaaagtcccttaggcatattgaaattcctatttatacaaaggaataaacagtactagaaattgtaactatgtgagtaaacagataatattttttctccataaaatgtggttgactattttcacaaaaatagttaacaatgtaatgtgtgatttatagcatttaaaagtaaaacaggccgggcacaaaggttcgtgcctgtaatcccagcacttttggaggccgaggcgtgcagatcacttgaggacaggagttcaagaccagcctggctaacatggcaaaaccccatctctactaaaaatacaaaaattaaccaggcgtggtggtgcacgcctgtaatcccagctactctggaggctgaggcacaagaatcacttgaatccaggaggtggaggttgcagtgaggcaaaattataccactgtgctccagcctaggcaacagagctagactctgtcacacacacacacacacacaaaagaaaagtgtatgacaacaacagtgcaaaagaagcggaaatgaaaataatgttattttatataagtggtatacttttagatgaactacgataaattaatgatgtatactataaactctaaggcaaccactgaaataatgaaacgaagaattatggctaacaagccacaaaaagaaataaaatagaatgagaaaaaatatttaagttgttcaacagatgggaaaaaaaagaggaaaaagagaacaaagaacagatgggacaaatgggaaagtaatagcaagatgatagacttaactctacccatatagattatcacacttaaggtaaatgatctaaatactctaatacaaaagcagaggttgtcagattgaattaaaaaaacagacaacaacaaaaaaaagcaaaaaaagagccacaacatgctgcctacaaaaaattcactttaatataaagacacaaatagtctagaacaccatcacttttaaccttatttactcaaacctcctaactgatccctatttatttatttatttatttatttatttatttatttatttttgagacagagtctgactctgttgcccaggctggagtgcagtggcaccatctaggctcactgcagcctctacctctcgggttcaagcgattctcctgcctcaggcctcccaagtagctgggactatagcacatgccaccatgcccagctaattattatatttttagtagagacggggttttgccatgtaggccaggttggtctcaaacgcctgacctcagcctcccaaagtgctgggattacaggcgtgagccacagcacccagctcctcttcatttattcttgctacgcttcctccaatccattttgtgcatttgatgattttgccagtaacttctttatttttctggtaaaattacttatgggtcactgaggactgggatgttctttcttctagagggggtttgtgtctgcttttgccaggaagctggggtaccaccagtcaagtattactttaaactcaattcatgaattgagacttttttttttttttttttttttacgcagagtcctactctgtcacccaggctggagtgcagcggtgtgaacatggctcactgcagcctcaacctactgagctcaagcaatccttctgcctcaccattctgtatagctaggactacaggtgtgtgccaccatgcctgactaattttttaaatgttttttttagagatggggctcactttgttgcccaggccggtctcgagctcctgggctcaagtgatcctcccaccttggtctcccaaagtgctggggttacaggcatgagcctctgtggctagccaagactttttattttttagcctaaatgtgtataaaagttggcttgtggttacaacttatcaggattgatgatctctctctctctctctctctctgtctctccccacctctctcacatcccttgctctgctgagaagcagagcaaacattctagcagtttccagagagtaggatgggattacttctagtttacttttatcatcctttgggatcgcagtattactgggagaacacaagtatctcttattagacataccacctttgtagaatctggactttcattttagactttatttgttttctactataagcaatttaagttacagatctctctacacactgtttaagttgcatcccatgaattttgatgtgctttattgtcattattatatagtacaatgtattttgtaattttttgtgatttgtttggagagattgattaattagaatgatgtttaatttccaaatatgtgtgtttttttcctacatttcttatttttattgatttcaaatttatttctactgtagtcagatttaataattcatttatttttattattttcatttttttagagacagggcctttctgtgttgcccaggtttgtcccaaactcctagtcccaagcagttctcctgcctcagccacccaaagtgctgggattataggcacgagccacccgtgcacaaccaacaattcatttaaaaagtgggcaagtgaactgaacagacatttctcaaaagaaggcatacaattggccaacaaatatatgaaagaatgctcaacatcactgtattagtctgttttcatgctgctaataaagacttaacctgagactggggaatttacaagagaaagaggtttaatggacttacagttccacatggctggagagatctcacaatcatggtggaaggcaaggaggagcaagtcacatcttacatggatggcagcaggcaaagagagagcttgtgcagggaaactcccgtttttaaaaccatcagatctcgtgagactcattcactatcataagaacagcataggaaagacccggcccataattcagtcacctcccactgggttcctcccaggacacatgggaattgtgggagttacaattcaagatgagatttgggtagggacacagccaaaccatataaataactaatcatcagggaaatgcaaatcaaaaccacaataaggtatcatctcaccccagttagaatggctattgtcaaaaaaacaaaaaataacaaatgctggtgaggatgtacagaagaggggactcttatatcctactggtggaaatgtcaattagcatagccattatgcaaaatagtatggaagtgaggtaggttacatagggtggtcacagcctcccttgaaaggaaacaagaaacttgtcaaattgatggagagaacaaatctcttgacattacacaaactgcatctggggctagtggttagaatatcctcagtcaaggaggtagaagagcaggagggaaaatccctaagttcgtgcaagtgcagaaacccacaagctgtgttctcaggttgacatatactcattttaatagtaagaaacacacccttgggtagagaattaaaatgctaataatacatgtgatgtatgtactagcgtgtatggcaatattgcatgcacattcaagagaccacccaaaacatatttaacaacaatgcccattcccaccccctcatggataatcacgtaggactcccataacgggagtttcttcagtgtcaattggtgctgaagtagccgaccctgactctgctatcagcgtgtactttcaccttgcaataaactcctttgcctacttttactttggactggctttcaaattcttttgtgcagggaattcaagaatctgaaccagcccactgacaacagaggtttctcagaaacctaaaaatagatctaccagatgaggctgaaaatctgctactggctatttatccaaagggaaggaaatcagtatacaaagagacacctacatccccatgtttattgcgtcactcttcacaagagctgatatatagagtcaaccctaaatgttcattaacagacaaatggatagaaaatgtggcatatatacacaatgaaatactatttggccatgagaagaatgcaatcttgtcatttgtggcaacgtagatgaaactggagaacattatgttaagtaagataagctaggattggaaagataaatactacatgttatcactcatatgtgaaagtagagaaaaatttttagctcatggatttagagaacagaactgtgggtaccggaagctgggaagggtagcaaggaggggaggatagggagaggttggttaatggtgacaaaattacagctagattgtagaaatgagttccggtgttctgcaccattgtagggtgcatatggttaactctcatttattgtatattttcaaaaagctagaaaagaattttgaatactcacaacaaaataaatgataaatgtttaaggtgatggatatactaattactctgatttgattattacacattgtgtacacatataaaaatatcactctttatcccgtatatatgtacagttattatatgtcaactaaaaataaaagaaaaaaagaatatgatctatcatgatgtatatatcatgtgtacttgagcaaaatgtgcatgcagatattgtgtataatgttctataaatcaattagctcaagataatagataggattgttcagatcttctgtgtctttactgatattttgtctagttattgcatcattaccaaaaaaagggtgttaaactctccaaatgtgattgtagaattgtctattttgtcttttcttttccatttttactttatgtattttgaaactctgttatgacattttgctatgtattttaaaacttcgttatgtattttgaaactctgttgttagaatcatacatttatgattattatgttttcttgatgaaatgacccttttctattgtcgttgtttttgttttttctgaaatggagtctcactctgttgcccaggctggagtacagtggcacaatcttggttcactgcaacctccacctcctgggttcaagcgagtctcctgactcagcctccaagtagctgggattacaggcatgtgccagcatgccaaactaattttgtatttttattagagacagagtttcaccacgttggccaggctggtctcgaacctctgacctcaggtgatccgcccacctcggcatttttattttattttatttttttgagacagagtctcactctgtcacccagggtagaatgcggtggtgtgatcttggctcactgcaacctccgcctcctgggttcaagcaattcccatgcctcagcctcccgagtagctgggattacaggcacatgccaccatgactggctaatttttgtatttttagtagagatggggtttttctatgttggccaggctggcaactgactcctttaacaatacaaaatatcactctgtctctggtaacactctctgtcttaaactctattttagctgttattattatagccattttagtctttttatgctttctgtttgcatagtgtatatattttaatatgtttattctcaagttatctgtgtttttatatttaagatgtttctcttctagccaacgtgtttggttcttgcatttttaagtcgattctaacaatctttgcctttcaattgaaatatttacaccattaacatctaacattaacatttatttttctttccacagtacactggctagcatctcccatataatattgaacataaagtgtgataactgacatccttatttcattcctactctgagtggaaagggcaggggtggagaaagcattcaacaatttgccataattataattctttttgttacactgttttcttctgcattaaaaaatatcattacattttgcatgaattattaggagaaaatattttccaattttcctggaaaatgccataaccacgtctctcaattttgtttccatctttcttccacattttacataacctacataagagacacattatcaagtatattttacatggcttctcagtgtcttctctgtctgctaacaggtttaccaagagatggcactcttgtatttctggtggctatgtccatatcgttttgcctttaagacagcgtaactacttctttcaccagtattaaagacatgtacatttgatctggttcttgtggatgattttaaatgactcaagctaataatcctaattttacctaaacactccattattttaaaatgtattcctttatgcccacaataaacatttattgacattaggctggacattaggcttctctatggcagacattaggctggaccctagccatatatctattgagggaaaaaaaattattttctatataagtttccagaaagccaagatgtgttttaaaaacaaaacaaaacattacattctaaatgctgtaacaagataagaaaaagtgttgaggctgagagaagaacaaagcagcaagcaactcctggaaggaccactgctgcagaggtaataactggtgaaccatgttttggagaaggaaaaggtcaccaagagaaggagggggtccagggtgttcagaaagattgcatgcataaagatcaagggtaataaaaaaaattccgtattatgtaaatgtgaagttccaggaccatgagcttggagagcatgaagtacaggaggagggttggtttcaaataaatctgggaatgaaacagtgaagcctctggcagaactcacatctctttcctcccctcttccttgcacattccctttatggagtaattgcagggatgggaaaagttcaaaaccaccactgagcctaggaagtgctagggtaaagtggagaatgaacctgcgtgatttgctcatcctaaactaggttcttctaggagagcccttccccataaaatctgccctcctcgaaggggcccagacagcctaagctcacctcccaaagaccccttacttgctgactgaatctgattccacccagacatggcctaaaacccttccataactctatagccaaattcaattttagacaggcctcataccaacctttcttcctctaagtctgccaccctaggcaattctcaacattctctacacactttggggccatagacgtgctaccaagtctccagacctagacctgatggagcagtgctgtaatgagacgaccactggcctttgaaccagacccttctctgtggctcctatgcatctccaacctgttttgagcactgctgccaagacatctttggcactttgttgtgaagttttaaaactgaactaatctacaaaacacctaacctttaaaaattcattgtcatttcatatcatgaaagataaagaaaggccaggaaactgttccaggttaatagagactaaagagatagcaaccaaatgcaatttgtgatcctggattgaggggaaaaagtgttgtcagagacatgattgggacagctggtaaaatttgaatttgaatttaaagataaagtattgagtaatataggaagatgattatctgcaactttcaaatgtttcagtaagtatatatatatataaagagatataaagacatataaataaatagatggataggtagagaaaaagcaaatgtataatattaacaatctaggtaaaaagtatatgagtgttctttgtactgtttttctgatttttctatatgtttgaaatcattttaaaataagaaggtttttggggtttttttgtttgttttttgtttttagagacagcatcttattctgtcacccaggctgtagctcagtggcccaatcattgctcactgcagcctcaacttcctgggctccagtaattccccctacctcaggctcatgagtagctggtacttcaggtgtgcaccactgcactcagctaatttttattttttaaatttttgtagagatggcatgttgctatgtcacccaggctagtctcaaactcctgcccccaagtgatcctcccactttggcctcccaaagtgctagaattataggcatgagccactgcacccagccccaaataaaaaagtattttattttaattaactaattaattttgagtcagagtttcacccttgtcacccaggctggagtgcaatggcatgatgttggctcactgcaaactctgcctcctgtgtttaagcgattctcttgcctcagactcctgagtagctgagattacaggtgcctgccaccatgcccagctaatttttatatttttagtagagacggggtttcagcatgttggtcaagcttgtctcaaactcctgacctcaggtgatccacccacctcggcctccgaaagtgttgatgagccaccacacccggtctaaaaagtattttaaaaccacagtcccactctaccttgtcctacactaccaggggctaggatcaccccatgtcttctaggctatgagatagaggaatccaaggaagaagataagctacttggttcctctatagggtcttgtgtgtgctctcatgtgctctctctctctctctctctctcacacacacacacacacacacacacacacacacacacacatgaataccagagctatcactttcccagtctagtactcatctcatcccaagggttttgtgttgtagtggtttgctcatttgtttgttttgtttgtttgcttggattattctttttctctttttgcagctgaagggagaatttccaggccagccctttggccattagagttacagtgcctctattcaggcttcatagagagacctgggattcagtagtggggggcttttatccagttcaaaataatgcattctcaccaagatgtactttgaaataaaacaatactaaaacacaaaattttatttatgctgaacattgaatcacttttttctgtattttgtgtagaaagttatacacacacaaacacatttgctcctgctttgtttattggcccaggggtatgtttggtaatacttcatcaggcatgagtagtacgtcttggaaggtgtggtctaaagcctagactcctatctgcttccttcagcattctccagtgtatctgtcatctgtctaccttaggatggggtctccagaacttccattcacatttagaagagggcagcggctttctatggaaaatatgaactctcattcatctctattccttcttctagctatggtccagctcagctgtttggaataaagtatctatatgaagtctgcgaatggttctcagactggttgaacattagaatcacctgagtaccttctaaaattcttattacccagggcatatctcagaatgagtaccacagggtagggataggattagggatcatgatctctggagtctggtttaggcactagtgctgtttaaaactacgttcatgaggtggaggttgcagtgagccgagatggcgccactgcactccaacctgggcgacagagtgagagtctgtctcaacaacacaaaacaaaaaaaaccaactacccttgtgatttgaatgtccatccaaaattgagaaccattaggtaaggccaagctgtataattaaagagcagttttcatttgtctggtgtggtggcagctttttgataagggaagtattgttgccatccacatacctgagcctcactcctgagaacactggtgtgtatgttgctaaaattccccaggtgattctgaggttccttcctggataaaaaccactgaccctgggaatgtacccactgccaatctcctgcgtaaaccttggatactgggaagcctacagttgaaaatattgggcttgagatcctgaaacaaatcttgtatttcattaagactaatatttggtacagtgcagcaaatcaagggaattttggtggctgagttcttttagaacttttgcattgaaataggttcaagcagcaataagttaaaactacaacctcagctaaaggattaaaagacacgtgagctgggtaggatgaggtctaagattgggtgtggcggctcatacctgtaatcccagcactttgggagactgaggtgggtggatcacttgaggtcaggagttcaaaaccagcctggccaacatggtgaaaacccatctctactaagaatacaaaaaaattagctgggcgaggtgccaggcacctgtaatcccagctactggggaggctgagggaggacaatcacttgaactcaggaggcagaggttgtagtgagctgagatcgcaccactgcactccagcctgggtgacagagcaagactccatttaaaaaaataataataataataacaataataataattcagacatatccaggcatcaaacagatacctggggcagatgaatagtcttgagattcaagtcacacatgaaatttaggtggaaaatgacattggagaaatttgagattatgatgaatggaaatttttcaaagaggaatttcaggctctgttcttgaggggatagatggacttccaacagcaataacacaggattaatgaggacttgggatgttacataaattagagatgttagatggataaagagataaaagtactctctctaagaacatgggaccagagataggctcacttctaaccatcagatataactagcagactaaacggtctaaaaataaaaatcatgccccactcctgcttaagacattttaattactctcagtaactcttcagtttttctactgtgttatctttaactacagggttggtctgggtgtgcaacacaagaaagcctggcatatacatggattcaagtgtatgccatgtacaggtattctttcatgtactatttcatgtattctttttcacatctgttttttccttcattgaagtcaatggctgatattagattctactattcatgtgtactagttatatataattgttacaaaacaaattagcaaaaacttagtggcttaaagcaacacacatttattattacctaaggtctgtggatagaagttctgacatggcttaactgggttccctgcttcaagcctcatgtggctgcaatccaggtgttggctgagtctgaattctcatcagaggcttgattgtggaaatttccacttccaagctccctcaggtttgttgaaaaattcagttctttgcaccggtagaagcttcttggtagaggctgattcaacttctagaggctgtctgcagttcctgtcacccagggtggagtgcagtggagcaatcatagctcactgcagccttgacctcccagaatcaatctgttctcccacctcagcatcctgagtagctgggaccacaagtgtgtgccatcacacctgcctaaaaaacaaacaaacgaaaaaaaacccccagagaactttgtagagacaagctggtctggaactcctgcgctcaagcaattctcctgccttagcctaaaagttctgggattataggtataagccaccatacctggcatatggcaagtcttgagcaggacaaatacagatgatttatgtctgtcttccatggtattctaggttattgttgagatggtcctctattgtcttgttccatctattgattagataaaacgttgttccttctgttatttttcaacagtagcttttatgtgtctctctttatcttaaaattctaaccaaagagctgctcttttcttggtgtactttacctttggttgatccttcttaacctcttcttgccctctggggcctaagatgagggctgttatcagatgtgagtctatgggaaagcaagcaagaggttcttcagcctccgttcagccttaaatgtctaggtagaaatcagtcatggcccttccaatgtggtacagaccagatcacagagacaggggtctcagccaaggtcttgtggcctaagccttatagaaataatgagtgtttacttacttggagaactcccttggaatatctttttttgtgaacctgaggcaacttttggtgatttcttgatgtcttgggaatcttggtctagagccatttcaacctgatttcttttcatgtcagtggcattttgtgaccagatagtaaataagttctatgatgttcactcagagaaatacaatgacttatgatgtgaagcttctgtggttcagcccttacttcatcttcattccctcttatctgcatctgtctcctgcttgggaacaaaagtctggcttcattctatgacccccacgttgagtttcttagtagcacttacttttcaattaggagtgtcctcacttctatccatcagacataactagccgactaaacagtctaaatataaaaatcatgtcctactcctgctgaaaacattttaattactccccatcatttaattttttctactgggttatctttaacttcagagttggtcttgtgtgcaacacaagaaaacctggcatatacatggattcaagtgtatgccacgtgcatgtattccttcatgtactatttcatgtattctttttcacatctgttttttcctctaaaatttatttccttttaaaaatgaaaattttgcatttgactaaatttgtcaaatttagtcaaatttgtttaaaaccatttttaaaatgtttcccgaagttttgagtgaagttagtacttcagaaaaactgttttgtatttttcatgtgacctcagtgcactgctgtgcatttccatttctgcgtccacacacatttgttttgaggaaatataggaacgacaagataaagttcaagctcctggacattgcataaaagaccgtcatgacctggtcctgttgacttccctagatttcccgctatttcctaagttgagatttttggtttggatgctttgtgttttcctaaaatcaaaataggtttttgccttttatgattatacagtaaataaatgctatttgtgtgaaactttaaacaatacaaaaaaaacctaaggaagaaagtcagattcatctaaaaatccttgtggccagaattaactaccttagttattattttctctatctctctctctcaatgtatatttggtgtaggtataggggtgtgtgtagtgtgtgtgtatgtatatatctgtttctattcctgtatgtggatgtgcacaacgcatcctgctttgtacactacagtactagcatttttctaatgtaattcaatattgttgaaaacattttaaaaaagcttgtatatatacacacacatacacatacatgcatgtatgtacatatacacatacagacaaaaatgtatcctatgtatattcacacatgtatacacactcacacgtacatagagttttacatccatagtttataaatgttgcttttttttggtcacctttttgctaagtcttacacttttttttttttttttgagacggagttttgttgtcattgcccaggcttagtgcagtagcgcgatctcacctcactgcaacctcgacctcccgggttcaagcggttctcctgccttagcctcctgagtagctggtactacaggtgtgcgccaccatgcctggctaatttttgtagtttttttatagagacgaggtttcaccatgttggccaagctggtctggaactcctgacctcaagtgatctgcctgcctcagattcccaaagtgctgggattacagatgtgagccactgcacccggccaagtcttacacatcttttttttaccactaaactgtttacccaaacctgataacccaagtcaacagctattatggctcacacaatcttatgtaaacaaagatacagatatatagaattttcttgattaatattcagaaaaaaatggagtccctttatacgtccttagtatctgctttactcatttaaaaatgtattacattatatgaaagtattcaggtcaaatgttatagatgtgattcattctttttaactgtgttatttttctgcaatgactatgtatcacaaagtactcagtcttccactgatgaaaatttgggctatttccagtttgtcttccatttttctttcttcctcttggattttcactcaatgtgtttactaatttaggaagaatcaatagtttttatggtattacttctcccattcaagaatatagcatatggtatagtatagtagagtacttagtttaatttagccagatcctgttttctgccctttaataaaattctatcattttctgcctttgagtcacattttccttgttcatataattcttaaaaaatgtatagttttcattctaagggaacataaaaacttctttccatttctattcctgtctagttaattctactattgggaaaagtaactgttaaaaaaaattcttatctttccagtcagttcaccacatttcctttatacctttgtactttaatccccagtcatgttgaacacttcttattcctcacaccaagcctcaacgggtttgctctttctggaaggtgcttcccctgtattactgacttattcataccacacatggagactggcgcagccctgttctgcctgggaagccttcccctgatacccctagttggcaggagtcttcatttgttcttttctagtcacctgtgcaagtttgtattgttcatgtttatcatccttcattctagttgtctgtctctatgtgtggtctcattcagtggactctgaactcttatgaagtcatgtcatgggtcagatcttaataaattaatattgtcggaagctaatgtcatgtctagaatacagaaaatttatcaaaaaaaaatatagtatgttggctgggcgcagtggatcaagcccgtaatcccagcactttgggaggccgaggcaggaggatcacatgaggtcagaaattcaagaccagcctggccaaaatggtgaaacctcatctctactaaaaatacaaaaagtagccaggcgtggtggtgcccacctgtaatcccagctactcaggaggctgaagcgggaggatcacttgaacctgggaggcagagattgcaatgagctgagatcatgccactgcactccagcctgggcgacagtgagactccaactcaaaataatagtaataataataataataattgtatggaattgaactgctctgattggaaatagctgttttttaaaaaattattattttttaagttcctgggtacatgtacaggatgtgcaggtttgttacataggtaaacgtgtgccatggtgatttgctgcacctatcaacccatcacctaggtattaagtacagcatgcattagctcttttacctaatgttctcccacacccccaccccatcctcccccaacaggccccagtgagtgttgttcccctccctgtgtccacgtgttctcattgttcagctcccactcataagtgagaacatgaggtgtttggttttctgttcctgccttagctgttaatgtcaggccagagaggcttaaatttttaaggatctctggacttttcttctacattactcttgatgtttataaatgttacaacttctttaatttcattaaatgtataccttattgagttgatttaactgagttaactttgttatatgaaaatcatgattgggagtgagggggttaaaccagctacagagatcttgattgttggtggtgaagcaatgcaagaattcattcattcagtaaactaatgtttattaagcgtgtactgtcttagtctgttcagactgctgtaacaaaatatcataaactgggtgacttataaacaacaaaaaatttatttcttacagttctggaggtgggaagtctaagattaaggccctggcaaatttagtgtctggtgaggacaggtagccatctttttgctgagtcctaacatggcagaagggttgaataaacttccttgggtttcttttataaggacactaatcctagtgatgaggtttctgccctcatggtataactactgcccaaagacccctccttctaatattatcactttgtgggttaggatttcaacatgagttttgagaggatacagacatttggatcatagcacacaccataggacagacactgtgccaagaattgtggatatagtgattctcaaaatgaacaagatcccctcagagagcttgcaaaatccagctataaaattatgctttttaaacaaattatgcagtttgaaaaatctactctgaatcttacttgtggcattgaatactttcggccactctttccttattatattaaatatttactcttgtttgggggatccagtctcacctactttttctaccagaactggtatcagctcatgctctgccttatgcaaattaagaaaatatcataccttttgggtaaattaagccaagaaagttctcctttcttctctttctctctttctttctttctctctttctctttctttctttctctctctttctttctttctttctttctttctttctttctttctttctttctttctttctttctttttctttctttctttctttctttctttctttttctttctgacagggtcttgctctattgcctaggctggagtgcagtggtgcaatctcagctcactgcagccttgaactccagggctcaagcaatcctcctgagtagctgggactataggcatgtgccacaacatcaagctaatttttgcatttttttgtggagacgggatctccctatgttgctaaggctggtcttggattcctgggcttatgcgattctcctgcctcagcctcccaaagtcctgggattacaggcatgagccactgcccctggccattataactattttcattggcttatcaggcacatgataactataataaatcaataaccagaatttttaaataaagaaaggaaggaattgtttcaactcttcctgctacccctctatccctcaaaagggtaggctgaatgttgtcctccaaagatatccatgtcctaatccccagaacctgtaaatatattaccttatatgacaaaagggactttacatgtttaataagttaagaattttgagatgggcagattttcctgaattttgcagatgggccctagtgtaatcacaagggtccttataagagacaggcagaagagtcagaataagagaaaaatacttcaagatgttacactgctggctttaaggtggaggaaaggccaagagccaaaaaatgcagtggtcactacaagctgaaaagaaaaagaaatggattttcccctaaagcctctggagggggcacaaccttgccaataccttgattttggctcagtgaaacccattttggacttctgacctttagaactgtaaataaataaataattttgtgttgtttcaagccatcacagttgtggtaatttactacaacagcaataaaatagaattaaatacagagatctgaggagttgagtaggataagcctactccagcaggttatttcgggagtatggtgagactcactaggatggcggaactcaattaaggaagtctgaagctgataagccagagagggaaggctctcacttcattttataagggttgcgtcacactaggaagatccaatagcaaccacagtctcaaaattaatgattacaaataggacacaattccaagagtcgggagccaagcagaaaatggattagggaagacatggatgatatgaaacaggaaggaggggtacaaggcagcttcctgggaagttgccagggcagtcacagttcacattcattaggctgtgggcaccaaatgcatatggaaaatctagctgacttaactgaactcctgaagaggaatgaacacctcatttattgaggagctactaccaattagaatatgtatttcatttgttcaataaccccatgagtacagtaacacaatccttgctttactaaagcggaagccaattcaaagaggttcagtgacttgtccaagctcagggaaaacactaggaagtgaatatgggtctgactccatcactgatttcaggagccctgccctttcctccacaccatgcccccttgctttcagaaaaaaaggcttgttgactgaatggttgtatgcacagttcaaagcagaaacacacgatgacatcttttgagatactctaacagtgagaacttgaaaatgaagttaaaaattaagcggcaaaaccaagccgaggctttctgagaaagtggggccaaacctgttgccgtctgactgccacgtggctcactatttatccctgtaaaaatctgcaaaagtatttgaaagggaagaagggacagaaaactccctccttttccaagttagccttatagtctagggcttaaaatactggtttaatggtgaaggtaagtgcttttcttctttttgggtagaaggattattactaacttaccaaaggtccattaaggggagggaacagttttaggagaagtcagagaaaagacattaacagcaacataaggatctccatctggtaatattgcctaattccaaaatgaagagactctctgaaaaagataactgattcaatgaagaccctagggcaaggcttgagaagccactggtaccaatggacactgtggacaatggtcatttctccaaggacgctgtgagtattaactgtgatgctgtgattagtcagactgggattggctgtggaatgaaatactgatcagaactgacaagatttgtgtttgggactgtggctaacgagtcttttcagacttctatatgaatttgaaatggtctctcaggaaaaggagaacatggccgggcctggtggctcacgcctgtaatcccagcactttggcaggctgaggcgggcagatcacttgaggtcaggagtttgagaccagcctggccaacatggtgaaaccctgtctccactaaaaatacaaaaattagcagggcgtagcggcgcgtgcacctatgcgcatgcatagtgcgcgtgccagctattcagaaggctgaggcaggagaattgcttgaacccaggatgtagaggttgcagtagttgagatcataccactgcactccagcctaggtgacagagtaagactctgtctcaaaaaaataataataataaaagaaaaggagaacatgaccaaagttatgaataagactgaaggcaagaaaattgtacgcttgtagagatcacctagcttgttgccctcattgtacagctaagaaaaggcacccagggacattgtggtcagcaccaatttctcagaaagataggcagatgatgagagggccctcagtttttctaacactgaaggaattgcttctatgttttctggtgaactcctccccactcatcttgaggattccaggccagaagaatccactttaaaaaagaaacatttaaaaccaatttaacaaccaatcaaaggcacttttatagaaatacatttcatttgctgttggcctgtatttatggatctgagagggctagactgccaatattgtgactgtttattattattgctgttgctagtatctagaatattatacaacatataacactttgcaatttacgaggcatgtctcatacttttgttttcactccaaactgcccagtgaagtaacattatcccaattcttcctatgaaacagtgaaagccctaagagtttttgaaactttacctggtttactcaatttgggaatggcagagcagaattcagtccttgaatatcctcccactgcaggttcatgctctttgatctaggtgtaacatttactctgagtaaactaggactctgggctaacagagatgaagcaagacaggctggatattaggagaatctaagagcaatctaacgaccattataataaaatcatgagttctagacttaaaaaaagggaaaaacctgtttttttgcttatgcgtataccataatatttacattatttatttttttctcaaattcaacctatacggtgtcaagtaattttttttaatataacattttcctttaacttaatttcaattcatttttctgtgtctacttacaactttggcactagaattcacaatttttttttagaggtatatctccttaaagggaagggttctgacactgttacatgttctcaattgtttgcaaataggttaataattattccagtgtctctaagtacatatcaaccatgccagtgttcagcctccataattttattagcttctgtgcttattttggaaaaacatttcccattaccatgaaagacctcagtttaggatggtttggtatgttagcctgatttctgcattcgtctcatgcaaaggaaaataggaaacgaagaactgaaattacctattgatacaaaatcaaagtagcatttgaaaccataaaacttaagtagggcttttcatcctttctcgttagacagcaacagagaatgggaagaaaaactaaagtgatgggtttgtgatacaattccagtaacataaagagcaaggagaagtagttttgttgtgtttatgtttaatattcaaagctcaacctaaaagtatttttcattatcaaacttccttctagaataaatgattaaaacttgatttaaaatatacaaattctcctttataatacctcaaaatggagctaccccattgagttttaagcttgtgattaaaatattacgaaaacaaaggggaagttgtaataggtagaacaagcagtagtctaggcattaggggatctggtgctggctctgtgcatcatgtggtttcaggcaacttttcaaattttctacgcaaattttcttatcaataaaataaacagttgggccagaggatctctgagtctctttcagctttcagtgtttataagattggagaagttggtgggaaagctttaagtggagtgtaagtaattgcagctgcatgtacagttaaagagttgccttcagccaagccacgggatcttgcataaaaagtgaaatcaaatagaaaatggtccaaactctgggtttgaccacagatgacttcagctaggatctgagtgtagagcaatgagctgaactcctgatatccagatgttagcaagacttggaggccttctaaggcagagcaacaaccagtatctgtcctggtgctgacctgatcttactagcaattgggcctccatttgggtccattgtacaaaacaacaacaacaacaacaataaaatctccaaacacccaaaattcaaaatttagatggagagatactattcccagaattctagagatatttggaaagcagaaaactatacttgccatgctgatgaagtccaattattgctcttttaaatacatttagctacttctgaatataaaatgagtatctactaattatttacaaaatcacttggtaaatatagaaagtcacaaagaatgaagtgatcatcctgttttgtaacccagaaatagtcattactggcacttgtgtgaatcagtttctattcctgtatgtggatgtgcacagcgtatcctgctttgtacactagagtactagcatttttctaatgtaattcaatattgtcgaaaacattttaaaatagcttccatcacaataatctatcaaattgacttgccagactctcattattaggttaatttatctctaacattatgcagtcatgagtaatactacaaaggatatttttggacacaatttttcatctatgcctttctttataatccttcatcctaaggtcacagattatgaatatctttaaagtacggacaagtcttttaaattttgtgtgcaaaaacagtgcaaagccttgaatgataaaatagaggtttgatatatgtgtttttttgtttgtttgttttgagacggattcctgctctgtcccccaagctgtagtgcagtggcacgatcttggctcactgcaacctttgcctcttgggttcaagcaattatcctgcctcagcctccttagtagcagggtctacaggcatgtgccaccacacccggctgtttttgtatttttagtagagatggggtttcaccatgttggccaggatgatctcgaacacctgacctcaagtgatccacccacctcagtatcccaaagtgctgggattacaggtgtgagccactgcacccggccgatacatgtgtttttaaagtcacagaaatttcagatgtcttgaaggattttaagcaatttaaaaaataaagtcatagaagcttcaatttaggaatgaatggaaaattgatgatattcttaggatatggatttttcctaaaagaaacaaatgtatgcatccccaaagataatttgattagtatacaaatattaaattaaacatgtccatatttagagccatgaattctctttgcctgtcacaatagctggatttattcacaattgtagtaattagtccctgttcattataattttctaggtgatatgaagactttgtcagtccaagcaagtgtccacattgtgtgtagcaaacatgagaataaacattttaaacttttaaatgtaatacatattagtgttatgtaatgtcatccttcatgttcgaaggcacatggaacattgttctggtggtacagaggggagagaaacaccatcagaatgaaaggaaagaccgctctggaaccttcctccttagctcttgagcttagtttaattgtcctgtcttatggtctgctacaagcaataccactcttcaccttcgcatgcttctctgtggtttgataaagtacatgcaatttttcatttaattcttccagctgcactaagaaaggagccttatctttattgaacagatgaggaaatgaatgattagagaatttaaatgactagctctaggtcacacagctggaacttacagccagatttccttttaacaatcctgtaaccaaaagcataccagtagtgccccataaaatgtaagttatagagctgtgttgggtcaaaacttttactgatgctaagaggaggcaacattaacaaggggaaattatttgtgtattatgttttggattatgttctctccatagataaaagactgtcgtagtaaaagagattcagggcacagggaaactccaccacaaagcgtggtaccatttcccacagaagctaaatggacgggaagcctgccaccaggaaaggtaaagccactgctcttgtttgcaggctatgttaataagctgaagcttattccgacacatttacacatctctgcatcacactgacccttcgtaaagatactcccagtgtaacattggagccagctccagcccctgatcctgttgctttttccttagccccatgaaatcatctgcgagaaattaagccaaataagcaataaatcctgggatctagggagtggaataagttttgggaaagtctttttttttttttttttgactgagtcttgctctgtctcacaggctggagtgcagtggtgcgatctcggctcactgcaacctctgcctcccgggttcaagtgattctcctgcctcagcctcccgagtagcttggactacaggcacacaccaccatgcccagctgaatttttgtatttttagtagagatggagtttcgccgtgttagccaggatggtctcgatctcctgacctcgtgatccaccggcctcggcctcccaaagtgctgggattacaggcatgggccaccacgcctggcccgggaaagtcattttaaaccaacctatgtatgaatccctactataatattctcaccaagcggctggctctttctcctgagcttggaaacctccagtaaaatggaaataattatttcccagaccaccactcttatctgtgagcttttttggccattaaaaattatttcttccattatatttttatctgtgtcttcacaggttttctctttctttcactttagtgcttttcttcaaataagcaggaaaaatccaatctatcatgcacatgggaaccctttcaatattggtctgtggttgttccattttatggggatgcttttaaagaaaaaatttgtcctttcaatatattgaatatcttccagcaccacatcacctgcaagctttgtaaaaatagttctacatattaattttttttttttttgagattgagtctcattctgtcacccaggctggagtacagtgacatgatcttggctcattgcaacctctgcctcctgggttcaagtgattctcctgactcagcctcccgagtagctgggattacaggcatgcatcaccatgcctgggtaatttttgtatttttagtagagatggggtttcaccatgttgaccaggctggtctcaaactcctgacctcaagtgatccacctgccttagcctcccaaaatgctgggactacaggcgtgagccactgcaccccacgtagtttttttttttttttaagttgaacatatgtgaaggcaggacctagtgacacatagcaataacatttccaagtagacattacactagggaattagtcaaagtgctcatttaaagtaccatctctcaaatgtattaaaagagaatccttggatgtgcaataccttaattcaaaggcagctcgttatgtataaactctcaagctttgtgataaacaaatgtgcataacagatgggactattgacttacagcccagggaattttattgacgctgagaaggttatgtgactggctctgccactgtcatccccattcacttcattttggagcaatatgacataaatgccttacatgtgggttttctctatttatcatgtgtttcctatccccttgaaagatggccatatttgctttacttggttataagatcccatattcgctgtcttgaagccaaccaaataatttgacaaagtgggtttgtagtgctggctattttggtgaaaaaaagacaatgagacttcatgtgtcatccaaagttctatcagatcgagctgtgagagaaaggaaaagaaaggggtctcagtcaggatgctcactgcatacatctgtgttgttgtctaggtccagatttctgttcattacgctatgggctggctcttatcatgcacttctcaaacttcaccatgataacgcagcgtgtgagtctgagcattgcgatcatcgccatggtgaacaccactcagcagcaaggtctatctaatgcctccactgaggggcctgttgcagatgccttcaataactccagcatatccatcaaggaatttgatacaaaggtaagtatgatggaaaatagggctctttgttgagagaaaaaactttgaaaggaaggcatagatcttgattctgtggagtatggaagtatacatttccaatgacaaattaaaactgactggaactatttttctttgagacattgcttacttcaataataaaaataagatttcattgaggttattatgattataaggtgggggaactgtagagttaaatgtgaaaaatttaaaaatggaacagtttatgtgatgtcttcaatgaaaaactaggtattacctgggcacattcttataggttactcaatcctattcagttctctgcctgttttattgtttctgagcaattttatatccctgtaaattctatataaccaatagaaatgcaaacgattcttgtccatagctttgcaaataaattttgccaagagaaaaatcagttaaaacttttctccactcacctcccagttgaattagccaattttgctgtttgtttgtttgtttgttttttgagatagagtcttcctctgtcattcaggctggagtgcagtggcatgatctcagctcactgcagcctccgcctcccgggttcaagagattttcctgtctcagcctcccaagtagctgggagtaagggggcatgccaccgcggctggctaatttttgtatttttagtagagacagggtttcactaggctggtctcgaactcctgacctcaggtgatccacccgcctcggcctcccaaagtgttgggattacaggtgtgagccactgtgccaggctctgctgtatatttaaagtctatttcagcattgcttcctgcttgtgttatgcgtgattctttgagttttcctttgaaccagttataacatcttacttacttcctccattaatcaatgagttaaataaaatctttgttgtatgtttattttacatttatatgaaaaccatgaatttacccaattaaaaaaattatcctttaaattatcttgtactgtacatttcccatgtcatccctataattcatgattaatgattttattacattggacctagcttatttacaatgagtacataaatttattgtctccagtctttcctccattatcccgtctacatatccacactgagtagattcactactcaggaatcttggacaccttcaagttgccaaacatgcagtgttcactggacatgctgtgttccttcagaatttgggcctgcttctcagcacactcacatctgctatcaatgacccatggaaagtttttgccctgagcaagccagagtccctgttagtttcttccaaatgctacaagttcacttttgctattttttccgatgagataaaattttcctttttgactttctacaaatcatagtcatttttcaagggatagttcaagtattgcttcctttctgggaccttcccaaattattattttctcctctcaaagtctctgttttatttatgttcatcctcaaatcttgattctcacatgaatcatataccttgtattatttatagtttttttgagtaggtaaaatatttcatattttatattctttggctctctactttatagcatgatgccagatatttaggggccttactgcatttattttttattttattttaaaatctattttattttttatttatttattttaaaatctatttatttttaggtaaatattcaggtaatataatttatgtaattatttaggaattttaggtagttattttaaaataattcaaattatttattgagttatatcagaagaatgtgatcttattcatttgtaatatgtgttttaggaactcagttcagccagggcagaccataattcccaaacttgacttttctttttaattaggcactgattttggttaagagttcagtaaagttttgtgtgtgtgttttaaaaaattctttgatataagagtcaagatgttactcaacttttactagaagcaaaatagaggaagtgctttcacagatgaaatatctctcaatgttttcttccatttacttcttcctattattcatctatataatcattttctttacctcttttcttcatttcttctgtttttctctcctactaagacaagcaaattaggggtataattggttatttgggaaggtaggaagaatacagagagaaacaaaaatcaatattttatactagggtctcactaacctcaagcaactctgactgtaaagtagattttcataataggacttcttgacaaagagttttcctatttttcccccaggcctctgtgtatcaatggagcccagaaactcagggtatcatctttagctccatcaactatgggataatactgactctgatcccaagtggatatttagcagggatatttggagcaaaaaaaatgcttggtgctggtttgctgatctcttcccttctcaccctctttacaccactggctgctgacttcggagtgattttggtcatcatggttcggacagtccagggcatggcccaggtatccagatactttctcattcttggtgggatccagatttctgaattctacaaaatatcaaaggtcttaatgattttcatttcagggaatggcatggacaggtcagtttactatttgggcaaagtgggctcctccacttgaacgaagcaagctcaccaccattgcaggatcaggtaagtgtgcacagatgggtcatagctttgtcatctgttccatcccactgtgtcttatcttctatgaatcaaatggtttggggaagagagagaaaaagtactgctgaaaaattcaacaatataagacacttgcatcacaaataggaaagatgcatctgtgcagtaaagacattgaagcttagaagtagaaaaaaccattgtgagctaggtttcagctcagaaaagccttagtagtcagaaaagccttagtagtcagaaaagccttgtcggaaaaagtttaaacctttaagaattgcacacatggaaaaagatcaagtaagctatatatacaccatcttagcaatgattttgaagtgagaattaaggctaccacagctccaggtggtaaggagagaaatcaggctggaagagtttgaagtttctgtattattctaagctctttactattctattatgagctcattaattctcacaacaaccctctcatataagtaccattttaaattcttattttacagagaagggagttaaggaaggtggagattaagaaaattgcccaaatacaaatagccagcaggtggtaggtctgagatttaagcccatgcagattttagccccagagcagacattctcaatcactatgctagactgcctttccatggtatgtgatcctactcaggcctctacagctttatcattgctgttctccccagcctgtcgtgctgagagtatatactcgaagagcagaactaaaattccatccagcttctcactcctaggtccactacacagctgcatcctgcagacttttacctcaagcaaccctcctgcgttcttgcttccttccatcatagttgtaaccatctcctctatttgcaaatactatctgctgatctctctcttctagactggtttctttcaaccttcttcccaccaaaaccaagttagcttgctaaaataaagatggcgcatttttactcacccgcttgagaattttcaatgtgttccttcatgcttacagagtaaagcctgacctctttattgcatgaatacaaaagttcttagccatctggccccaaccttgttccactcaactcccctgtgcaagcatggctccagtggcactggacattggctgctctccacatagatctgcactgcacttccctctggctctgctcccgttagtttatatgcctggaaagttctttgcccctgttccttgtgccaaaattccatctatcctattgcatagcttatgtaaaaacttcctaaacctttttttttttttttttttttttttttttttttttttttgagacggtgtctcactcttccgcccaggccggactgcagtagcgctatctcggctcactgcaagctccgcctcccgggttcacgccattttcctgcctcagcctcccgagtagctgggactacaggcgcctgccaccatgaccggctaattttttgtatttttagtagagacggggtttcaagccaggatggtctcaatctcctgacctcgtgatccgcccgcctcggcctcccaaagtgctgggattacaggcgtgagccaccgtgcccggccaaaacttcctaaatcttataattattatcaatttatcctcagatatacttccacgtacattgtagttttattatatttatattttacatcttttttttcaaattgcagtttgggacccattagtgagtcataaaatccattgagcgggttaaaatcattattttaaaaaatgagtagaatagaatagaaattgttggagtgcattggacatggtaaagttaaatatcgattcatgaaaccatcgtttgaggcatatgtgtgtggttgtatgtacaagtgtttatgcatattggtgtgtgtgttatgttaccctgtaaaatgcatttcttactataggtctctgtgaaatatgtgtcttgttgttttttaatgtagacttccaaagcctacatggcatttcactagtgacaatcaattttattcacatttttctctccaattggaccagaagctctttgagggcaggggctgtatcttaccgatttttgtaagtctttcatttcctgcccctagcctcatattagatcatgcaagaatgcaactgtaatcacaagaaaatgctaatgggctgtgatagcagagagttactgtgacaaactaagggatttagatttggtcacattggtgttgaggagccattgaagaatcagagagtgtgttactattatttgttaattttaattatatcatattactttactggggaaaatctgtgagctattttagaaataaatactctcattgcccaataattctaagtctgccacctcactgttgggacattgtttagggaggccacgaagtctcagcctttgatattttcataagtgtttttctccctttttcctttagggtcagcatttggatccttcatcatcctctgtgtggggggactaatctcacaggccttgagctggccttttatcttctacatctttggtgagtcactttctcttaaatcctaatgcctccatttcctgagcatccattttggcacctacaccacccacattcttcctatatgaaagaaaatgtcctttatcaaatggaagatgataaaaaatgtcaacggttggtatcatttttaatctagtcacacaacctgattaacaccttcctggtggttctgggaagccacacgcaaaaggtagaggagttgactattcacatggcacccaccgacttgtgatgcagtcttgtccttccatatcaagcaccttctgcagaatctctaccaccacatctgaagtgcctgctatatgcagttaagatgtcaaagatagtgaagtacattttcaatgtgtcttcatatttcattataattattatttctgtccaagatgcctttcacctgttctctaccaagttaatcttgcaaagttcaattcaaatgttcccttccccatgggcccttccagggcttaccctgtcagattctggcattctctcctttatgatatttcctctctaggttatgttggtgtgtaattatttatttctccttttctttccactagactgtgaaatgcttgaggcaaggaatccattctatgttttcatcacttgggtgtcatcatggtgcctgatttttagctttaaaataaaagaatcagtgaatccagtaattagaggggatttaaagaaaactagtcctcagaatcttttaacatagaatgttcttcaaataaggaattccaataataagacaattttctacacttgattttgtttttatagccaaatggtgtcattaaatatagtcctggcctgaatggctttctcattaatgatgctaattattttggtttgtacatgttaaccaggtattgtacaaaaatatttcttttgggaatccataatggatgtatggcttgaatacaaataatactgtctcttgtaagtgcattggaaatttttccctgccacatgatttcatggaaggttgtttcgtgtatgtatgactgcaaacctgactattcagatcttccgcaacaagacaacttatgtgtgcattaagaagttgctgcctaaaatacataacactgtaatcattggagactttaaagtaattaatcagctatgcaatgccacgctcctgttatctccagagggctctgacattgacaaatggtggctttctatttgagacgtaatatctaaaaagctttaacaggtttgtagaaggattgaaagaaagaatgggaacatttaggtccttatggtagaataagcattaattgattagtgtgtagaagggagaggcatgccacttcagaggaaacttccttcccccagtaaacaaatctacctaaaaactaattttatcccttcttcccaggtagcactggctgtgtctgctgtctcctatggttcacagtgatttatgatgaccccatgcatcacccgtgcataagtgttagggaaaaggagcacatcctgtcctcactggctcaacaggtacagtgcacaccttgtacctgtggcccatgcagaggtctctagggcagggtgtggatctcctctgagaggcaccatcttggctgctctaatactcatgctgattagatctttcttttcagcccagttctcctggacgagctgtccccataaaggcgatggtcacatgcctaccactttgggccattttcctgggttttttcagccatttctggttatgcaccatcatcctaacatacctaccaacgtatatcagtactctgctccatgttaacatcagagatgtgagtttacttcctatacttctacgaaaatgataatggtaataaggagaaacagttctgtgttacctattacattctggctttacatataaccattaatttaaccttcacaatgaccttgagagaggcattgttataattcccttttcacagatgtggaaacaggacacttagaggtgagataacttgccccaggttgcacaatactaagtgatagagctgctgcagcatccatattcttaaccactatgctatactaccacaccagctgattccaaagcttcttttagaaataatattgctgggccaggcatggtggctcatgcctgtaattccagcactttgggaggccgaggcaggcagatcatgaggtcaggaatgcaagaccagcctgaccaatatggtttactaaatatcatctactaaaaatacaaaaattagccaggtgtggtggcaggcacctgtaatcccagctattcaggaggctgagacaggagaatcgcttgaacccaggaggtggaggttgcattgagccaagatcatgccactgcactccagcctgggcgacagagtaagactccgtttcaaaaacaaaaaacccaagaaattaatattgcttttatctggagcccagagtgatgcagcttctggccctcttatctgagacagtgttcttttagtgtgaaaaaggatgctaattttcccccaaacaacccacagtatcatgggggtaagttaatggctggtctgtgtaactgacaaattttggtgctaacgtatctctataactactctgtataaacttccttccttcagagtggagttctgtcctccctgccttttattgctgctgcaagctgtacaattttaggaggtcagctggcagatttccttttgtccaggaatcttctcagattgatcactgtgcgaaagctcttttcatctcttggtaaggataagcgtgtgggcccatttaaccaatcccttttctgcacatggtctcagagggttccctgacagcatgtcctcattgcccagggctcctccttccatcaatatgtgctgtggccctgccctttgtggcctccagttacgtgataaccattattttgctgatacttattcctgggaccagtaacctatgtgactcagggtttatcatcaacaccttagatatcgcccccaggtaagagctctacctgttttttcccctcctccagacccctccagaggtgttagacctcagtggtcgccgtgaaactctttaatgttactgacattgcactaatggcagaatgacaaataactacaaatatctgtctgtggccatttttagaacaacaaatgtggcatttttagaacaacaatttccaatcttggccagtaatcattttgacaaaaaccttcccaagcttccctaacagagattgaactgtgtatgctgggaaaaggcccacacacaggtgatttggaaaagtttccatggtgttgttcatattagctaccacatatatatatatatatatatatatatatatatatatatatatatatatatatacagtcacaataagccagctcctgtgccaagacttgccatatatcaacacatctaatcctcacagttatattaggtaggccctattgttatccccattttataagggagaaggctgaggcacaaggaggttaaatggtgtgactatggtcacataaaggcagagccaggatttggactgggggagtctggctttggagtctgtgtcctgcccgttgcacaaactggcttctacactgagcagccagggtaaagaaacgtggttcccagagagactgcattgctccctggttattgacttggtagattggtaatttcaggtttggcaaatagacattgccctgaatgtctttaggtgaatgaaaaactgcattaagcaaaatgactttgccattagagctgaattgcattaaagttgagttgctgcagaagctgtaggtggctttctatataaaatcatttataaaatcatcttcccatagatatgcaagtttcctcatgggaatctcaaggggatttgggctcatcgcaggaatcatctcttccactgccactggattcctcatcagtcaggttgggtcagtttattgaacatcttcaagtggcaggtattgttttaggtgttggagatacacacggtgctctaaagatctggatggcaacacaattactctatttacatgagcctctaaatcagactctggtaggtcagatttcccagaggaagaaaaatataagcttattttctcaagatgaatagatgttagattgattaaaatgagctgttccggtgcagaagacagcacgtatgacttcctagaggtacatgagcatgaaacagttcttagttatgaccagaatgaaagacacatgtcaaggaatagcaagagacgaagacagaggggcaaaagaagatcatgaagaatatgttcagactaatccaatttttaaaaaatcacaaaagggaaacaaagtgtcctaggccagtttaaagataatttaatgtctggaaacagatcggctgtgagacattgcaaggaggcttgctcggtgtttggaaatgcaggctcatgaggaagatgaaaagacagacccaggcagggatggaaggactgactagaaccaacttacaaagagaagttttgtttttactacatttctatgtgatcaagttcccaggttaatatttgactaaactgctaggaatccactgtgactataatgctggaaatgacttagtagggctttctgaggagggtcacacagaagaccaaagagaactcatgttgaattgagatgggttatagtgatagttgtcaacagccaatacagaaacaaaaaaaaacaaaacaaacagcaacaacaacaacaacaaaaaaaaaaaacagagaagacacaaacacaatgccacaatgccattttaggcataattttaaatgagtaatattatatgttgaaatccaaattttcagaaaaacattagtgtattttatttttgtttaaagaaataaccatctcaactcagaaccccatgtgcattttggccattttgtttccaatagtttcataaactttcttaagtaactactgcacattgttccttatattccttgtgatcaacattgcaatacacaactgggagggctactagaactggtgtagaaggaacttgtgagattgatcattttctctgttttttacatctaggattttgagtctggttggaggaatgtctttttcctgtctgctgcagtcaacatgtttggcctggtcttttacctcacgtttggacaagcagaacttcaagactgggccaaagagaggacccttacccgcctctgaggacataaagttacaaacttaaatgtggtactgagcatgaactttttaaacattttttacttctctccatattcctgaccatagactcagcagttcttaactctggctgtgtgttagtcttccctggggagcctttataagacactgatacttgggacccactccagagattctgaatgaattggtctggggtggaacccagatactactaatttttagatactccttagaggtttctagcatgcgcccggggttgacaacagctggacaaacttgaaaagtcaattcatgtggcctttgaattttcctcattggaaagtactaaataaataaaaattcatgtgaaaatgatcactgataaatatcttcatggtggggcaggttattggatgcagagaagatctgctcggaattgtagccatatgttacagatctcagcaccgatcagaactgtaaagctataatccccagaattaaagtttttattattttttatacattgtaaaacatagacgtttatttatgtgattaaattctattaaaatttacatgctaaaataaaatagaccattttcaaattatttagatccagatatttccatcagattaaacagatatttatttatcctagcccaattgcaagagattaatgatgagaaaatgaccaatacaagattaaataaatgaggttaacttagaaatcaaggacagagaagatagaactggaaagcttgtattgtgagaagaatgaatgtgaaggaaggcaatgtagacacttccagaagggatagcaatatagtttagaccatataatgaaaattggagagagatgacagagacactttcaagtgaaatgacaatttatatgggggagaaaaatattgaagacataacaagatgagaaaaggcatagaaatgtatcacatacaaggcatagaagtgtatcacatacaagagaagttccttttgagcgtagaaaaagataatttaaccttcttcatatttttcttactttcccaagatactcagataggcagcgtcaactctaacaggaattaatttggctcctaacacttaagacatatcctttagtttgtctcctcacacagaactgattctggttttgccacaacatgtctagagaagaagttcccaccatattttaaatcctattaaaaaactgcttggacaagaaccttgggctaattcagcagatgaagagaatctcctaatgcaaatcaatgggtatttttgagcaagtttttcagaaaaacagagtgtcaggccctgagggtggtactaagatgagaacattgattttgccttcatgatattgacaacacaaagaggaaagggggtttgcagaaaactaaaagaagaagtagaagaaaaaagaaagacatagtataataggtagtcaaattatgtacagaaaaaagaggaaaaaaaaccaaaaaagggtgggggacagacaacccaactaaaaaatgggccaatgacttgaacagggacttcataaaagagaaaatgtaagtggctccttaacatataaaaagatgttcaacttcattagtcattacagaaatgaaaatcaaaactacaatgaaataccactataaaattaactaatggataaaatgaaaggagatggaaaacaaaatgttgccagacatgtggagcaactggaactttcatacgttacgaatgtgaactttggaaagctgctcggcaatatctcctaaagctaaatgtacaattccagtgactcagacattttacttagaaatgcacatatacatccataaaacatgtacaacaatgttcataggagcactatctgtaatagcctgaacaggaagttgtctgttaaaaaaagaatgagtaaataaaccacggtctatttgtatagcaatgagaattaacagaccccaatatataatagatgaatgggtctcataagcacaatattgattaaaggaagacaaaacgcacattcttttaaaggtttataaaatactttttaaaaacagctacaaccaatccgtcctgttaaaaatcagtgagcgatttcccttgtgcagggatgggggttgtggctggatggatggtacttaagaagtgctcctggggtactagaaatattttatttcttgacttggatgtgtgtttactttgtgaatattgtacatttatgatttgtgcacgtttatgaatgtagaaaataaaacagaaagcaaattcaaagtatcatccttttgagagcttctgctctgacttcgttttgaccaatggagcagttgggaaggggtcttggtccttcggtcctttgctttttttttttttttttttttttagacagagtctcactctgtcgcccgggctggagtgcagtggctcgatcttagctcactgaaagctttgcctcccgggttcatgccattctcctgcctcagcctccccagtagctgggactacaggcacctgccaccatgcccggctaattttttgtattttttagtagagacggggtttcaccatgttagccaggatggtctcgatctcctgacctcgtgatccgcccacctgagcctcccaaagtgctgggattacaggtgtgagccaccgcgcccggcccctggtcctctgctttcatgttcttcttggtcctgttcctcctcctcttttgttggaacttccagtatcagagcaggaaggaaggcaatgggtcaatcgatgctgtcagcttttggatcaaactgcaagttctcaaacagcaaaattaatgagctcaggctttgaagaaaccatgaccctgaaagcatcagttgcttccaattgcatcagttgccacgggtgataagaacaatgatgactcagaatgcctaggttttcccagcagcttctctgaggttttcccagcagcttctctgattgattcctgacagatgacttcggtgtgtcagactttcagggtatctttccttatgtgatggtttgaggaagagttaccattcacattcctaatggcttcagaatagatgcaattgtgaactgataggaaacatttctaattcatctcccctccccatccctaaaggattgtttctaacaatagtcatgaaaattaattcacttttctcaaatagtttattgtcatctacctaatgatgagatgacttactttttctccttgactgttaaatattatgaattatattaatgtatttcttaatgttgagctttcccttgaatattcttttgatgtacgacagaatttgattcactaatagtttatttaggactttggctgatgtactgatatatgagattggctctgtatgcatacatgtgttttgtgtatcttttttgtgtctggatatggagcttatgctgatttcaaaaacaagaaaggagaactttcctttttccccattactctgaaaaagattgactagaatggaatttttataattgctgttgttatttgaaagcttgaaagcattggtttgtaaaaatcatgcaggctgaaagccattttgaggagactttgataactttctcaatttccttcagttactggtcttttaaggggttttatatttttctttgatcaattttgaccatttatgttatcttggaggatcatctattttacacactatttaaagtatatttgcaaaaattcaactgttttatcaggctatctttttaataatatattcattttatctatatctgaggttttagcttctttgtacttctgacccaattgcatgtgtgctttctttctccttcattagactacttagtcatttactaattttaagaatagcttgtcttttatttatttacttatttatttttgagacggagtctcactctgtcacccaggctggagtgcagtggcgcgatctcggctcactgcaacctccgcctcccgggttcaagtgattctcctgcctcagactcccgagtagctgggattacagtcatgcaccaccatgtctggctaatttctgtatttttaatagagatggggttttgccatgttggccaagctggtctcaaactcctgaccttagatgatctacccaccttggcctcccaaagtgctgggattacaggcatgagccactgcgcccagccctgcttgtctttttattttatatttgattagctttatcttttatcaagcttatgtcctatttccctttgctttacttcatataaattttgttttggatagtttatttatttttcatttaattatgaaacaggttaaagcttagaggaaaattgctcctctaagtccacttttgtgggcagattacattttgctgtgttgtgctcccaaattcattgttcttttaatgctttatttctcaagttaataacctatatagtaaaaaagtggctgttgactctcagctttttttttttttttttttttttttttgtagatacagggatcttgctgtgttgctcaggctggtctgaaactcctggcttcaagggatcctcctgccttggtctcacaaaatgctgggatgacagacatgagacaccatgcccagccatgtctctctccttatatataataagaaaacagacacactgaggcatcctatcatctcactcttggtttcactactgttctctggaagttttgctctgaccttttgcagttaatgtattaattttgcattgagtagtttccatagaagaattatagcatttgcattctgttgggtattatacttttcactgttatttgaacataatttgagggctgaaaccaagatgaggcaagtgaggtgcccaggaagcaatatttaaggaggcatcctttcttaggctcatgcaagaacagaattggcacatgagagtgagtgcctccttaattttgagtgctggacacttcttgctcacttagcatacccctggacaatgaagtgttttttgttttgttttttcatgtccatcctttatccttcttcatctcaaaacatttcaatggagtatttttttggagcagtacttggatgagcctctgagtcccacagtagctgagaatttatttcatagtactctttatgatcactgtggagccttaaaacattgtaatattaacttagctgggaacagaaattttgttccacaatttgtcttattcagaacagtattgacttcctgctagtctcttctgatgtccaatatgaggaagtctagttagccagctactttttgtaggagagctatgtttaggctaggtgctataggattctctttatcctggaattccttcaccaagatgtgccaaggtgttaatcattttctcttgctttttggctggtggtcttagagtttccttcgattttgttttatttagtgattgtcctcaatttgttttctttactaagaatctctcttctatttatctgtatggtaaaaccttgttgcccatctttctggtttctgctgactttcatttttggaccttttactttgctttctccatggactttttggtagtggaggcaggcaaacactttccaaagtctttctcaatttccatcaatttcaacttatttcctaaaattgcctcagaatgtgcctatgtccacaatatccctccttccactttagaaaggaaaggcatccacactttatttaggtgcaatgcctgaagtgtaaacactttctggttgtcaacaaaggagtacttccaaatattggtttggggataacctgctaatgattaacacattcaccttggctcttggtttgcctgctccctcttcttttatctgctgtgtgtattttttttaatcactgagaatatgcacagtattgtatgttttattataagagaggactggccagagtgggaatgttctgaattcagaataactgaagcagtacaggataggaactcattctttcaaatgaagctggcatattttcccagagcaccaaatttcaatatatatttaaaaaacttgatatgaatgatacaataaagtggttagaacttttattaaaataaacttatgtcatgaaatacttattctaattatagtcactcttcatcttatttcatcttataacatgtttaatgttttcttttatttacaaaacaatttattttttgatgaaaagttttagaaatcaagttaaaaatattcaaaggaatgcctaaagttttcaaaattcttttacatgttgtacaatcaaaagagtctgaagaccatttagctatccaaattgtttatttttaagcagtatcccttctaatatttactatttataatccttaaaaatttgccttagcacaggagaattgcttgaacccaggagacggaggttgcagtgagccaacacagtgccactgccctccagcctcggcgacagagtgagactctgtctcaaaaaaaaaaaaaaaaaaaaaaaaaaaaggccaaaaacaaataaacaaacaaaaaaatccgccttaacattatttgttcattaaaaactttctttaatactactagtttccctttcctctcagcccattgtcatattttgatttttatcacttgctttgtaggacatatgaggtttttgtttttttttttttttggagatgcagtctccctctgttgcccgtgctggagtgcaatggcgcaatcttggctcactgcaacctctgcctcctgggttcaagcaattctcctgcctcagccttccaagtagctgggattacaggcacccactaccacgcctggctaatttttgtatttctggtagagacggggtttcaccatgttggccaggctggtctcgaactcctgacctcaagtgatccacaatccttggcctcccaaagtgctatgattacaagcatgagccacctgcccagccagaatatatgttcattttgagtcctttaacaaagtcataagaattttaggaattcagttactttcttgagaaaatctctgaaaagatgccaataatttgtagccaattatattgatttctctttttcatattgagaattgttttttaaaaagtttgtatgtgtgaagatttttgcactgtagttaaagaaaccacctgtgtgttggttaagccataagtacatgtattcaaataaattgaggtggggttactctgagaatcaaaggaaaacctgaagaaacaggcagcctcaaaaggtcttagctgtagcaacttgctccattgttgaaataaataggcttgaacttgtattttccctctactcaacatttaaggtctcagaagataatataattggtgaaatttaagtaaagtgctcactcttttgctttaacaaaccctagagagctggtaggcagagcctcaacagaccgttttagcttccaaagggagttcaggacaccatgattcacgaccacaatacatcacacataattgagaaaagatagttccaccaaataaagttgaaatgctgacaagaaggggtaagaaatcttggaaataggtttatataaaatttattttttccttttttattgttatggaataggaccagttctacttaagccacccatttgccaaaataaagtgagaatcgtttcttttggggactcctctttgtagctccaagtgccactaacaattcttaggacctgagctataagccaggtgatttcagttaatatgatcaattatttcatttaaatggctctaatgtgcagagggaacggagcccatcagcattccctgcagggaactgcagtggcttttatcaacttgaacagctagctttcaactgttttgaaatcactttcagggtggtcatgtagttgcttttttgaaatcagaagatgattctgcctcttttaatatgtgactcctcagattcagaaagtgctcgctagtcttaagagtgaattaccctcagtggtccagcgcttatgaacccacatctaaccctatcccctgggggaactatcagagaaattggtgccatggacataagaggaaggcacagtgaagcagagagccccgcatgatgaaaatcagtggacagcatcattatttacaactttgtaatcacccaggagcatgaaaatccaggccaatctggcaccatgagctctaatttttgttggagttcttggaaccgattctgatgaatgactgtttagccattttagagtgtggcatacgtggctgctggcatacagaggttggatgtaaacgggcctttgccctctcttatgaacatagacaggaactaaactgtgtcacataggttccaaatggtggcctgaatactatttacaactaaggtacaatgaaattgagtaagtcttttcctcttttgcagataccatcattattcatatatttcttcaaagttaactatttgtatttggtaatttttaatagaaatgtaataattgcttctcaagtttagtctttagtcttaaggttgatgctctccatgtccttccaaaaaaaggtatgttgcttttattatatcctcgccttcagatgggattattccattttgttctttgttaatatatactttgagccactttttttgtggctctgggtgagatgctataggtacaatgacaagtgatacgtgtgttgtccctgtcacaaaagtggatagcctaagtggtgacttttacctccactccaaatatatgtatcacacaccagccgtatgccaggcaccactctaggtgctagggatacagcagtaaacagacaaatgcaacccctgcccatgtgaaagagaataagacaataaataagtaaagtgcatgttatatggaggtggcaaatgctaaaaagaaaaattaagcaggcaagaggactcattgaaaagatgacatttgggtaaaagcccatgtatatatgttctattggttttatttctctggagagccctgactaatacacaatgactttgagaagttactggcttttgatttatcacactattcggagtgctgagagccttcttagtgtgtattcagtgttttaagagagcttgtggatgaataataaataggacaaaatttatccaaacttaagccttgctttaggtaaaagggctcctcttacaaggtagaaggttattatttgacatttaaatccaactgaagactaataagactaattaattaaaagtttttaaatcacaactgcgtgcaaaataaatggaactgccatgctcgccaagtgtgcatgagtggtgtgcatgggagacagcacgaagctaatcccactcatcttgcaggttgctccatttttctcctaaaatcagtaagacagaagctggtcagattatcaagagccctagttaaacacagcagtagcatttggaaggggttgctctcattaggcagtgcctgaccacaacaagagatgaacaagccctgtatctgaagccatcatgcctagttatggtccccgactgttcatgatgcctggaagggaggccccctgcaccctagaaagctgggtgggttctactgtctgctttactgctaaaaaccctcttctttggatctggactttacctctatctgatttttttttctaatatatgatttggcactgagtctgtcactgctgctaactcagcagttctagggtcattgccccattgcctcacagaaagaatttcatagcttccagcatcctctctccttcattatactttgatttcagcattgctattttttctcttgggtgttgcagctctctctctccttcccatgtcttgttggttttctgctaactcctgctttttttctttttttttttttgagacggagtctcgttctgtcacccaggctggagtgcagtggcacaatctcggctcactgcaacctccgcctcccgggttcaagctattctcctgcctcagcctcccaagtagctgggactacaggcgctcaccactatgccccactaatttttgtatttttagtattgctgtcatcaatccacatgtccagaagcacctagaaactctaattctttgtaggtatcaaaccctaggactctttcctctaatcacaatatataatccctgattcccaaacacggtcttttcatatacattttccactgtacatactttctgacctggaaagctcttacacaaacacgccctcccctaggaagcctttataaatgttcccaggaagaatcagtcacccaacagtgtccttgtcacatcttaggttctacacctttatttgttctatctgaatgtaatctcccagagggtgttatcatctttttttttgagatggagtcttgctttgctgcccaggctggagtgcagtggcatgatctcggctcacagcaacctccacctcctgggttcaagtgattctcctgcctcagcctcctgagtagctgggattacagacgtgtgtcaccacacctggctaatttttgtatttttagtagagacagggtttcaccgtgttggcaaggctttcctcgaactcccaaactcaggtgatccacccacctcagcctcccaaagtgctgggattacaggtgtgagccaccatgtccagccccatctttttcttttagtttagttcttaacaaatagtctgacacaaagtggatataacaatattttgaattatgaataactaaatgaatatttccagatttcctggtgctctcaaagttttatgttacaaaagaaaaacaagtctaaaatacctgcctcaagtttttatctgtactatgatttcaaaccaaataaaaaacaggtggggtaaaaactgaaacaggaaatacatataactgaaaaattttggtatgttagtatgataatactaggtcatttttcctgtttccccaacttcattttctatagcaataaaaagaaacaagtaaatgtatgttaatttaatttaaaagaagtagtctaccatctcttctgttaaaaagaaaaaagtattttaaaaaattatctctggaaggatacacagggaacattgctctggtttcttccaagagagaaatgaggaactagagagcatggccaagtggggttttgcttttgtttttgtttgtctatctgttagctttttattattttcttttgtaggtttgaatttcaaaccacataaatctgttacatgctcataataataagtttaaaataaaacttttggctgggtgcaatgacttacacctgtaatcccagcgctttgggaagcagaggtgggaggatacttgaggccaggaatttgagatcagcctgggcaacatagtgagaccctgcctctgtagaaataaacaaaaattagctggatatggtggtgcatgcttgtactcctagctacttgggaggttgaggcaggaggatcctttgagtccaggagtttgaggctgcagtgagctataatcacccactgcactatagcatgggcaataaggtgagaacttgtctcaaaaaaaaaaggggggggggaaacaaataaataaatataaacaaaacttttgtttcaaaatatgtaatatttagcactaaagaattctgaattgtagagctaaaaagtacttaaaagttaataactattgtctcctttaaaagaattgttatcaaagtataatttttatccagaaaatcatccatatcagcaagctaaactttctcaaaatgacatatccatgtaattagctcccaggtaattagcaggcagcctctactcaggttgagtattcctaatctaaaaattggaaattcaaaatgctccaaaatctgcaactttttgaatgctaacatgattctcaaaggagtgctcatggagtatttcagattttggatttttggatttgagatactcagtataatgcaaacattccaaatctgaaaaaatctgaaatacttctggttctaagcataagggatactcaacgtgtgttagctaattagacccttcatggtctcttctagacctcagcttcttcaaggtaacctctatcctcacttctaatagcatgaacttttctgttttagaataatttggattttcaggaaagttgcaaagatagtacaaagacagtacaggagagttcccatatatctttcacctagctttcccccattgttaggattttacattattatgatacatttgtcaaatataagcaactcacattgatacatgaaactctattaaccaaaccctagactttatgtggatttcaccactgtttccactaatgttttctttctgttccaaggtccaatctggaataccacactgcattttcttgtcatatctccctagtctttttttgtctgtgacaatgtctcagtcttttcttgcttttcatgaccttaacagtcctgaagatcatttgcttttttttcataattacaccggagttatagattttttgaaataataccacaagggcaaagggcccttcttgtcacatcattttagggagaacatgatatccacatgacatcactgatattaaccttcatcatgtggtttaggtaatgtttcaggtttctctactgcaaagtgatttttttcccttaatttagcccacctgaacttatcaattttgttttcttccatgactaatacttttgttattatagctaaaacttcattggggccaaatcttagatcatgtaaattttcttctatattttattctaaaagcttgtaatgtttgatacattctaaaagatgtaatgtttgatacattacatctagtcctttgatttatttttagttacttttgtataaggtgtgagagatgtctccagtttcactttattaacacattgtggtgttccagtactatttgttgctaagactatcttttttccattgattacctttgccttagttggcaatatttttgttggtttatttctagactgtttatctcattccactgatttgtgtctatctttttgacaaaactgttgattacagtaagctttgaaatagttcattttttgtgtcaacttgactgagtcaggggataaccagctatctggttaaacattatttctggctgtgtttgtgagcgtgtttctggatgagattagcctttgaataggtgatcctagtaaagtaaactgtctttcccagtgtggatggcattatgccacctgatattcagggtctgaatagaagaaaaggcagaggaagggggaatttgggcctttttttctgcctcactgcttgagctgggacatctcatctggtctcctgctcttgaactgggatttacatcatcagttcctctggttctcaggccttcagattcagactgaatcataccaccagctttcctgggtctccagcttgcagattacagatcatgggactcctcatcttccataaatgcatgagccaattcagtctatgtccttgaaaactgccccactgcagattaaggcttttttccactaggtgaaataaagaagcttgttagacagatttcccttcatccagtgccctctcctctttaagttacaacacattggctacacctaagtgcaggggtggggatgagggtatagtcctcttgtttgctgagaagagaactgtattgggaaagctctagaagtgtttgatacatacataaacaaggcatggtttttgcacttaatttcacattacatttttcccagaaaaaaaggaatgtataggcatcacgtaactgtactagctggagtcattcttcctgattatcaaaggtaaacagttattaatcctataccaagatgtcaaggagaagtacttttggaacacaaggaattctctgggagtccttactactctcaagcccagtgaaaaagttaatgaaaaactatagtaccttcctataagctggatgactaattaccaggctcatttaggaatttgccttaccaagtaaaacataagggcagctgaggtgctgactgaagacaaatggagcatagaataagagtagtaaagaatgccaaaaatgctgtcatgtatccattgacaaaaggagctataaagcctttaggtattttcacacttgctctgttacgtaaatgtatgtgtgtgtgtgtgtgtgtgtgtgtgtgtg

SEQ ID NO: 3 - DNA, 20 bp; single-stranded, linear
cgttagaacgcggctacaat

SEQ ID NO: 4 - DNA, 20 bp; single-stranded, linear
gccgattcattaatgcaggt

SEQ ID NO: 5 - DNA, 20 bp; single-stranded, linear
ctgtaaaacgacggccagtc

SEQ ID NO: 6 - DNA, 19 bp; single-stranded, linear
gcaggaaacagctatgacc

SEQ ID NO: 7 - DNA, 21 bp; single-stranded, linear
gcatcagcgattaacttctac

SEQ ID NO: 8 - DNA, 22 bp; single-stranded, linear
ttgcattgtggtgaaatcaggg

SEQ ID NO: 9 - DNA, 21 bp; single-stranded, linear
ctgagtaattgtttaaggtgc

SEQ ID NO: 10 - DNA, 21 bp; single-stranded, linear
ctgagtaattgtttaaggtgt

SEQ ID NO: 11 - DNA, 20 bp; single-stranded, linear
agaagagatagatatggtgg

SEQ ID NO: 12 - DNA, 20 bp; single-stranded, linear
gaatgtgaccgtcccatgag

SEQ ID NO: 13 - DNA, 28 bp; single-stranded, linear
caactgaatatgcagaaaaaagtacacc

SEQ ID NO: 14 - DNA, 21 bp; single-stranded, linear
agtagctgggactcacggtgt

SEQ ID NO: 15 - DNA, 21 bp; single-stranded, linear
agtagctgggactcacggtgc

SEQ ID NO: 16 - DNA, 21 bp; single-stranded, linear
gcgccaccactcccagctcat

SEQ ID NO: 17 - DNA, 15 bp; single-stranded, linear
tcacacaccgattgg

SEQ ID NO: 18 - DNA, 16 bp; single-stranded, linear
ccaaactgatctttga

SEQ ID NO: 19 - DNA, 14 bp; single-stranded, linear
tatatatatatata

SEQ ID NO: 20 - DNA, 14 bp; single-stranded, linear
aaaaaaaaaaaaaa

SEQ ID NO: 21 - DNA, 10 bp; single-stranded, linear
aggatggtct

SEQ ID NO: 22 - DNA, 12 bp; single-stranded, linear
ttgttgttgttg

SEQ ID NO: 23 - DNA, 14 bp; single-stranded, linear
cttttttttttttt

SEQ ID NO: 24 - DNA, 12 bp; single-stranded, linear
aataataataat

SEQ ID NO: 25 - DNA, 11 bp; single-stranded, linear
ttttttttttt

SEQ ID NO: 26 - DNA, 20 bp; single-stranded, linear
atatatatatatatatatat

What is claimed is:

1. An isolated polynucleotide consisting of at least 18 consecutive bases to about 100 consecutive bases of SEQ ID NOS: 1 or 2, or the complement thereof, wherein said isolated polynucleotide includes at least one SNP selected from a group consisting of SNPs at positions 61465, and 35983 of SEQ ID NO:1, wherein said SNPs are found in a general human population with about 25% or less frequency.

2. A kit comprising at least one isolated polynucleotide of claim 1 and instructions to use the kit.

3. A kit comprising at least two isolated polynucleotides as in claim 1.

4. An isolated polynucleotide consisting of at least 100 consecutive bases to about 235 consecutive kilobases of SEQ ID NOS: 1 or 2, or the complement thereof, wherein said isolated polynucleotide includes at least one SNP selected from a group consisting of SNPs at positions 61465, and 35983 of SEQ ID NO: 1, wherein said SNPs are found in a general human population with about 25% or less frequency.

5. The isolated polynucleotide of claim 4 which is cDNA.

6. The isolated polynucleotide of claim 4 which is RNA.

7. The isolated polynucleotide of claim 4 which is genomic DNA.

8. An array comprising a plurality of polynucleotides immobilized on a substrate, wherein said plurality comprises the isolated polynucleotide of claim 1 or 4.

9. The array of claim 8, wherein one or more of the polynucleotides are labeled.

* * * * *